US008486683B2

(12) United States Patent
Scott et al.

(10) Patent No.: US 8,486,683 B2
(45) Date of Patent: *Jul. 16, 2013

(54) BETA-GLUCOSIDASE ENZYMES

(75) Inventors: Brian R. Scott, Richmond (CA); Chengsong Liu, Ottawa (CA); James Lavigne, Ottawa (CA); John J. Tomashek, Ottawa (CA)

(73) Assignee: Iogen Energy Corporation, Ontario (CA)

( * ) Notice: Subject to any disclaimer, the term of this patent is extended or adjusted under 35 U.S.C. 154(b) by 237 days.

This patent is subject to a terminal disclaimer.

(21) Appl. No.: 12/790,079

(22) Filed: May 28, 2010

(65) Prior Publication Data

US 2010/0304438 A1    Dec. 2, 2010

Related U.S. Application Data

(60) Provisional application No. 61/182,275, filed on May 29, 2009.

(51) Int. Cl.
*C12N 9/42* (2006.01)
*C12N 1/20* (2006.01)
*C12N 15/00* (2006.01)
*C12P 19/00* (2006.01)

(52) U.S. Cl.
USPC .................... 435/209; 435/252.3; 435/320.1; 435/72; 536/23.2

(58) Field of Classification Search
USPC .............. 435/209, 72, 252.3, 320.1; 536/23.2
See application file for complete search history.

(56) References Cited

U.S. PATENT DOCUMENTS

| 4,461,648 | A | 7/1984 | Foody |
| 5,747,320 | A | 5/1998 | Saha et al. |
| 6,015,703 | A | 1/2000 | White et al. |
| 6,087,131 | A | 7/2000 | Gunata et al. |
| 6,184,018 | B1 | 2/2001 | Li et al. |
| 8,143,049 | B2 * | 3/2012 | Hill et al. ........................ 435/209 |
| 2004/0253702 | A1 | 12/2004 | Fidantsef et al. |

FOREIGN PATENT DOCUMENTS

| EP | 0 870 037 | 7/2002 |
| FR | 2 935 986 | 3/2010 |
| KR | 20030046570 | 6/2003 |
| WO | 2008/151079 | 12/2008 |
| WO | 2010/022518 | 3/2010 |

OTHER PUBLICATIONS

Henrissat, "Cellulases and their interaction with cellulose", Cellulose, vol. 1 (1994) 169-96.
Lynd et al., "Microbial Cellulose Utilization: Fundamentals and Biotechnology", Microbiology and Molecular Biology Reviews, vol. 66, No. 3 (2002) 506-77.
Teeri, "Crystalline cellulose degradation: new insight into the function of cellobiohydrolases", Trends in Biotechnology, vol. 15, No. 5 (1997) 160-67.
Wood et. al., "Enzymology of cellulose degradation", Biodegradation, vol. 1 (1990) 147-61.
Zhang et al., "Toward an Aggregated Understanding of Enzymatic Hydrolysis of Cellulose: Noncomplexed Cellulase Systems", Biotechnology and Bioengineering, vol. 88, No. 7 (2004) 797-824.
Chirico et al., "Purification and characterization of a β-glucosidase from *Trichoderma reesei*", Eur. J. of Biochem., vol. 165, No. 2 (1987) 333-41.
Foreman et al., "Transcriptional Regulation of Biomass-degrading Enzymes in the Filamentous Fungus *Trichoderma reesei*", Journal of Biological Chemistry, vol. 278, No. 34 (2003) 31988-997.
Berghem et al., "The Mechanism of Enzymatic Cellulose Degradation: Isolation and Some Properties of a β-Glucosidase from *Trichoderma viride*", Eur. J. Biochem., vol. 46, No. 2 (1974) 295-305.
Holtzapple et al., "Inhibition of *Trichoderma reesei* Cellulase by Sugars and Solvents", Biotechnology and Bioengineering, vol. 36 (1990) 275-87.
Teleman et al., "Progress-curve analysis shows that glucose inhibits the cellotriose hydrolysis catalysed by cellobiohydrolase II from *Trichoderma reesei*", Eur. J. Biochem., vol. 231 (1995) 250-58.
Enari et al., "Purification of *Trichoderma reesei* and *Aspergillus niger* β-Glucosidase", Journal of Applied Biochemistry, vol. 3 (1981) 157-63.
Christakopoulos et al., "Purification and characterization of an extracellular β-glucosidase with transglycosylation and exoglucosidase activities from *Fusarium oxysporum*", Eur. J. Biochem., vol. 224, No. 2 (1994) 379-85.
Riou et al., "Purification, Characterization and Substrate Specificity of a Novel Highly Glucose-Tolerant β-Glucosidase from *Aspergillus oryzae*", Applied and Environmental Microbiology, vol. 64, No. 10 (1998) 3607-614.
Saha et al., "Production, Purification and Characterization of a Highly Glucose-Tolerant Novel β-Glucosidase from *Candida peltata*", Applied and Environmental Microbiology, vol. 62, No. 9 (1996) 3165-170.
Gueguen et al., "Purification and characterization of an intracellular β-glucosidase from *Botrytis cinerea*", Enzyme and Microbial Technology, vol. 17 (1995) 900-06.
Li et al., "Purification and characterization of an extracellular β-glucosidase from the rumen fungus *Neocallimastix frontalis* EB188", Enzyme Microb. Technol., vol. 13 (1991) 622-28.
Perez-Pons et al., "A β-glucosidase gene (bgl3) from *Streptomyces* sp. strain QM-B814: Molecular cloning, nucleotide sequence, purification and characterization of the encoded enzyme, a new member of family 1 glycosyl hydrolases", Eur. J. Biochem., vol. 223, No. 2 (1994) 557-65.

(Continued)

*Primary Examiner* — Tekchand Saidha
(74) *Attorney, Agent, or Firm* — Fitzpatrick, Cella, Harper & Scinto

(57) ABSTRACT

Provided are modified beta-glucosidase enzymes, derived from the *Trichoderma reesei* Cel3A beta-glucosidase, that exhibit improvements in one or more kinetic parameters ($K_G$, $K_{G2}$, $k_{cat}$) comprising amino acid substitutions at one or more of positions 43, 101, 260 and 543. Also provided are genetic constructs comprising nucleotide sequences encoding for modified beta-glucosidase enzymes, methods for the production of modified beta-glucosidase enzymes from host strains and the use of the modified beta-glucosidase enzymes in the hydrolysis of cellulose.

15 Claims, 20 Drawing Sheets

OTHER PUBLICATIONS

Chen et al., "Isolation and Properties of an Extracellular β-Glucosidase from the Polycentric Rumen Fungus *Orpinomyces* sp. strain PC-2", Applied and Environmental Microbiology, vol. 60, No. 1 (1994) 64-70.

Bhatia et al., "Microbial β-Glucosidases: Cloning, Properties and Applications", Critical Reviews in Biotechnology, vol. 22, No. 4 (2002) 375-407.

Henrissat et al., "Updating the sequence-based classification of glycosyl hydrolases", Biochem. J., vol. 316 (1996) 695-96.

Knowles et al., "Cellulase families and their genes", Trends in Biotechnology, vol. 5 (1987) 255-61.

Varghese et al., "Three-dimensional structure of a barley β-D-glucan exohydrolase, a family 3 glycosyl hydrolase", Structure, vol. 7, No. 2 (1999) 179-90.

Huang et al., "Glucosidase *Trioderma* sp. SSL", NCBI Entrez Protein GenBank Acc. No. ACH92574.1, Sep. 28, 2009.

Chica, et al., "Semi-rational approaches to engineering enzyme activity: combining the benefits of directed evolution and rational design", Curr. Opin. Biotech., vol. 16, No. 41 (2005) 378-84.

\* cited by examiner

BETA-GLUCOSIDASE ENZYMES

FIELD OF THE INVENTION

The present invention relates to modified beta-glucosidases. More specifically, the invention relates to modified beta-glucosidases with improved kinetic parameters for the conversion of cellobiose to glucose. The present invention also relates to genetic constructs comprising nucleotide sequences encoding for modified beta-glucosidases, methods for the production of the modified beta-glucosidases from host strains and the use of the modified beta-glucosidase in industrial applications, including the hydrolysis of cellulose.

BACKGROUND OF THE INVENTION

Lignocellulosic feedstocks are a promising alternative to corn starch for the production of fuel ethanol. These raw materials are widely available, inexpensive and several studies have concluded that cellulosic ethanol generates close to zero greenhouse gas emissions.

However, these feedstocks are not easily broken down into their composite sugar molecules. Recalcitrance of lignocellulose can be partially overcome by physical and/or chemical pretreatment. An example of a chemical pretreatment is steam explosion in the presence of dilute sulfuric acid (U.S. Pat. No. 4,461,648). This process removes most of the hemicellulose, but there is little conversion of the cellulose to glucose. The pretreated material may then be hydrolyzed by cellulase enzymes.

The term cellulase broadly refers to enzymes that catalyze the hydrolysis of the beta-1,4-glucosidic bonds joining individual glucose units in the cellulose polymer. The catalytic mechanism involves the synergistic actions of endoglucanases (E.C. 3.2.1.4), cellobiohydrolases (E.C. 3.2.1.91) and beta-glucosidases (E.C. 3.2.1.21) (Henrissat et al, 1994; Knowles et al., 1987; Lynd et al., 2002; Teeri, 1997; Wood and Garcia-Campayo, 1990; Zhang and Lynd, 2004). Endoglucanases hydrolyze accessible glucosidic bonds in the middle of the cellulose chain, while cellobiohydrolases processively release cellobiose from these chain ends. Beta-glucosidases hydrolyze cellobiose to glucose thus minimizing product inhibition of the cellobiohydrolases and endoglucanases.

Beta-glucosidases are produced by many organisms occurring in all five living kingdoms. Generally these enzymes hydrolyze aryl-beta-glucosides, among which is included cellobiose (gluco-beta-(1,4)-glucoside). Some also catalyze transglycosylation reactions to varying extents.

Filamentous fungi, including *Trichoderma* ssp., *Aspergillus* ssp., *Hypocrea* ssp., *Humicola* ssp., *Neurospora* ssp., *Orpinomyces* ssp., *Gibberella* ssp., *Emericella* ssp., *Chaetomium* ssp., *Fusarium* ssp., *Penicillium* ssp., *Magnaporthe* ssp., *Chrysosporium* ssp., *Myceliophthora* ssp., *Theilavia* ssp., *Sporotrichum* ssp. and *Phanerochaete* ssp. are effective producers of cellulase enzymes. Many of these organisms secrete beta-glucosidase enzymes. *Trichoderma* spp. (*Trichoderma longibrachiatum* or *Trichoderma reesei*) secrete small amounts of beta-glucosidase I or Cel3A (Chirico et al., 1987) and likely also secrete two other beta-glucosidases, Cel3B and Cel3E (Foreman et al., 2003).

The enzymatic hydrolysis of pretreated lignocellulosic feedstocks is an inefficient step in the production of cellulosic ethanol and its cost constitutes one of the major barriers to commercial viability. Improving enzymatic activity has been widely regarded as an opportunity for significant cost savings.

Cellobiohydrolases are strongly inhibited by cellobiose and to a lesser degree by glucose. Conversion of cellobiose to glucose is a rate-limiting step in cellulose hydrolysis because filamentous fungi, such as *Trichoderma reesei*, produce very low levels of beta-glucosidase and beta-glucosidases are highly sensitive to glucose inhibition (Chirico et al., 1987; Berghem et al., 1974). One technique for reducing cellulase inhibition is to increase the amount of beta-glucosidase in the system (U.S. Pat. No. 6,015,703), as cellobiose is more inhibitory to cellulases than glucose (Holtzapple et al., 1990; Teleman et al., 1995). However, over-expressing a beta-glucosidase in an organism such as *Trichoderma* may reduce the production of other cellulase enzymes and, in turn, may limit the rate of cellulose conversion to cellobiose. In addition, this approach does not specifically address the effect of glucose inhibition on beta-glucosidase activity. A complementary approach would be to use a beta-glucosidase with a higher specific activity which is also less sensitive to glucose inhibition. This enzyme would mitigate cellobiose product inhibition, but do so with lower amounts of beta-glucosidase (relative to the amount of cellulase(s)) and maintain its catalytic efficiency in the presence of high glucose concentrations.

Beta-glucosidases from most fungi have binding constants for cellobiose ($K_{G2}$) that range from 0.2-2.0 mM (Chirico et al., 1987; Berghem et al., 1974; Enari et al., 1981; Christakopoulos et al., 1994). These enzymes are highly sensitive to glucose inhibition; $K_G$ values for glucose ranging from 0.6-8.0 mM have been reported for these enzymes. Several microbial beta-glucosidases with higher tolerance to glucose inhibition ($K_G$>8.0 mM) have been reported (Riou et al., 1998; U.S. Pat. No. 6,087,131; Saha et al., 1996; U.S. Pat. No. 5,747,320; Gueguen et al., 1995; Li et al., 1991; Perez-Pons et al., 1994; Chen et al., 1994; U.S. Pat. No. 6,184,018 B1). However, these enzymes generally have a lower affinity for cellobiose (i.e., higher $K_{G2}$ values). As a result, the concentration of cellobiose at steady state would be higher using these beta-glucosidases, increasing the degree of cellobiose inhibition on cellulase activity. Therefore, these particular glucose tolerant beta-glucosidase enzymes have limited utility for the production of cellulosic ethanol.

In spite of much research effort, there remains a need for improved beta-glucosidase enzymes in order to generate enzyme mixtures with higher sustained hydrolysis activity on pretreated lignocellulosic feedstock. The absence of such improved beta-glucosidase enzymes represents a large hurdle in the commercialization of cellulose conversion to glucose and other soluble fermentable sugars for the production of ethanol and other products.

SUMMARY OF THE INVENTION

The present invention relates to modified beta-glucosidases. More specifically, the invention relates to modified beta-glucosidases with improved kinetic parameters for the conversion of cellobiose to glucose. Beta-glucosidases of the present invention find utility in industrial processes requiring efficient conversion of cellobiose to glucose in the presence of glucose concentrations that would otherwise inhibit a parental beta-glucosidase.

An embodiment of the invention relates to a modified beta-glucosidase of *Trichoderma reesei* produced by substitution of the amino acid at one or more of positions 43, 101, 260 and 543 in the beta-glucosidase I or TrCel3A sequence (SEQ ID NO: 116) and comprising an amino acid sequence that is from about 80% to 99.9% to that TrCel3A amino acid sequence defined by SEQ ID NO: 1 or 116.

The modified TrCel3A beta-glucosidase may be derived from a parental TrCel3A beta-glucosidase that is otherwise identical to the modified TrCel3A beta-glucosidase and includes the substitution of the naturally occurring amino acid at one or more of positions 43, 101, 260 and 543. For example, the modified TrCel3A beta-glucosidase may contain one or more amino acid substitutions at positions other than at positions 43, 101, 260 and 543, provided that the amino acid sequence of the modified TrCel3A is from about 80% to about 99.9% identical to the TrCel3A amino acid sequence (SEQ ID NO: 1 or 116). For example, this invention includes the modified TrCel3A as defined above and further comprising an amino acid substitution at one or more of positions 66, 72, 96, 235, 248 and 369.

The present invention also relates to a modified TrCel3A beta-glucosidase comprising an amino acid sequence that is from about 80% to about 99.9% identical to that of the wild-type TrCel3A of SEQ ID NO: 1 or 116 and which exhibits (a) at least a 20% increase in the $K_G$, (b) at least a 20% decrease in $K_{G2}$, or (c) at least a 10% increase in $k_{cat}$ for cellobiose relative to the $K_G$, $K_{G2}$ and/or $k_{cat}$ of a parental TrCel3A beta glucosidase from which is derived.

The present invention also relates to a modified TrCel3A consisting of the amino acid sequence defined by:
SEQ ID NO: 2 or SEQ ID NO: 117;
SEQ ID NO: 3 or SEQ ID NO: 118;
SEQ ID NO: 4 or SEQ ID NO: 119;
SEQ ID NO: 5 or SEQ ID NO: 120;
SEQ ID NO: 6 or SEQ ID NO: 121;
SEQ ID NO: 7 or SEQ ID NO: 122;
SEQ ID NO: 8 or SEQ ID NO: 123;
SEQ ID NO: 9 or SEQ ID NO: 124;
SEQ ID NO: 10 or SEQ ID NO: 125;
SEQ ID NO: 11 or SEQ ID NO: 126;
SEQ ID NO: 12 or SEQ ID NO: 127;
SEQ ID NO: 13 or SEQ ID NO: 128;
SEQ ID NO: 14 or SEQ ID NO: 129;
SEQ ID NO: 15 or SEQ ID NO: 130;
SEQ ID NO: 16 or SEQ ID NO: 131;
SEQ ID NO: 17 or SEQ ID NO: 132;
SEQ ID NO: 18 or SEQ ID NO: 133;
SEQ ID NO: 19 or SEQ ID NO: 134;
SEQ ID NO: 20 or SEQ ID NO: 135;
SEQ ID NO: 21 or SEQ ID NO: 136;
SEQ ID NO: 22 or SEQ ID NO: 137;
SEQ ID NO: 23 or SEQ ID NO: 138;
SEQ ID NO: 69 or SEQ ID NO: 139; or
SEQ ID NO: 70 or SEQ ID NO: 140.

The genetic constructs of the present invention comprise a nucleic acid sequence encoding a modified TrCel3A with an amino acid sequence that is from about 80% to about 99.9% amino acid sequence identity to SEQ ID NO: 1 or 116 and that comprises an amino acid substitution at one or more of positions 43, 101, 260 and 543, which nucleic acid sequence is operably linked to nucleic acid sequences regulating its expression and secretion from a host microbe. For example, the nucleic acid sequences regulating the expression and secretion of the modified TrCel3A beta-glucosidase may be derived from the host microbe used for expression of the modified TrCel3A beta-glucosidase. The host microbe may be a yeast, such as *Saccharomyces cerevisiae*, or a filamentous fungus, such as *Trichoderma reesei*.

The invention also relates to a genetic construct as defined above, wherein the modified TrCel3A beta-glucosidase comprises an amino acid sequence that is from about 90% to about 99.9% identical to SEQ ID NO: 1 or 116. The modified TrCel3A beta-glucosidase may further comprise substitutions at one or more of positions 66, 72, 96, 235, 248, 369 and 386 or any other additional mutations.

The invention also relates to a genetically modified microbe comprising a genetic construct encoding the modified TrCel3A beta-glucosidase. For example, the genetically modified microbe may be capable of expression and secretion of the modified TrCel3A beta-glucosidase further comprising substitution at one or more of positions 66, 72, 96, 235, 248, 369 and 386 or any other additional mutations. The genetically modified microbe may be a yeast or filamentous fungus. For example, the genetically modified microbe may be a species of *Saccharomyces, Pichia, Hansenula, Trichoderma, Hyprocrea, Aspergillus, Fusarium, Humicola, Chrysosporium, Myceliophthora, Thielavia, Sporotrichum* or *Neurospora*.

The present invention also relates to the use of the modified TrCel3A beta-glucosidase in a hydrolysis reaction containing a cellulosic substrate and a cellulase mixture comprising the modified TrCel3A beta-glucosidase.

The invention also relates to a process of producing the modified TrCel3A beta-glucosidase as defined above, including providing a yeast or fungal host with a genetic construct comprising a nucleic acid sequence encoding the modified TrCel3A beta-glucosidase, selection of recombinant yeast or fungal strains expressing the modified TrCel3A beta-glucosidase, culturing the selected recombinant strains in submerged liquid fermentations under conditions that induce the expression of the modified TrCel3A beta-glucosidase and recovering the modified TrCel3A beta-glucosidase.

Such modified TrCel3A beta-glucosidases find use in a variety of applications in industrial processes requiring enzymes that can retain high activity in the presence of normally inhibitory concentrations of the glucose. For example, modified TrCel3A beta-glucosidases, as described herein, may be used for the purposes of saccharification of lignocellulosic feedstocks for the production of fermentable sugars or in the production of compounds such as those used in the medical and food industries.

In another embodiment, the invention relates to a modified Family 3 beta-glycosidase comprising one or more of the amino acid substitutions selected from the group consisting of V43I, V43C, V101A, V101G, F260I, F260V, F260Q, F260D, I543N, I543A, I543S, I543G and I543L and having an amino acid sequence that is at least 80% identical to the amino acid sequence of a parental Family 3 beta-glycosidase from which it is derived. The positions of the amino acid substitution(s) are determined from sequence alignment of the Family 3 beta-glycosidase with a *Trichoderma reesei* Cel3A amino acid sequence as defined in SEQ ID NO: 1. The modified Family 3 beta-glycosidase of the present invention exhibits (a) an increase in the $K_p$, (b) a decrease in $K_s$ or (c) an increase in $k_{cat}$ relative to the $K_P$, $K_S$ or $k_{cat}$ of the parental Family 3 beta-glycosidase from which it is derived.

DETAILED DESCRIPTION OF THE INVENTION

Figure 1:
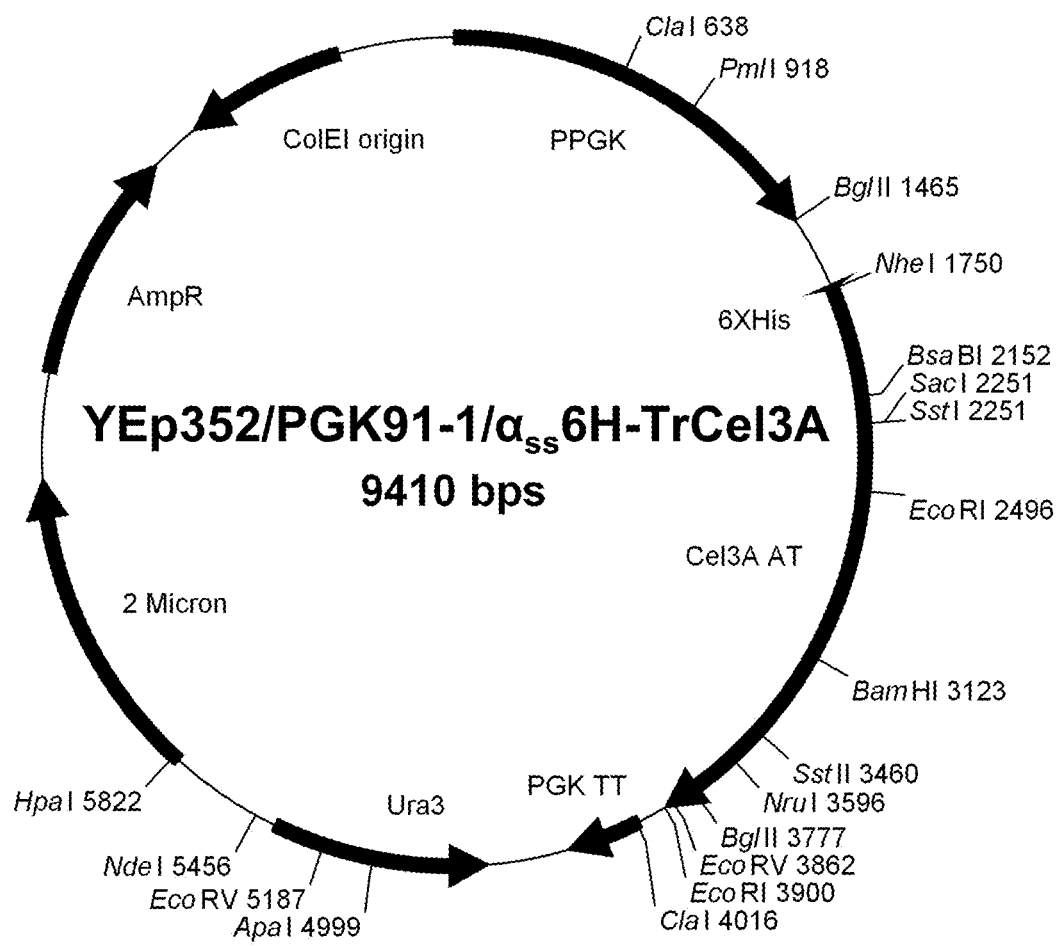
FIG. 1 depicts plasmid vector YEp352/PGK91-1/$\alpha_{ss}$6H-TrCel3A directing the expression and secretion of native and modified TrCel3A from recombinant *Saccharomyces cerevisiae*.

The present invention relates to modified beta-glucosidases. More specifically, the invention relates to modified beta-glucosidases with one or more of an increased $K_G$, a decreased $K_{G2}$, and an increase in $k_{cat}$. The present invention also relates to genetic constructs comprising nucleotide sequences encoding for the modified beta-glucosidase, methods for the production of the modified beta-glucosidase from host strains and the use of the modified beta-glucosidase in the hydrolysis of cellulosic substrates, such as pretreated lignocellulosic feedstocks.

The following description is of a preferred embodiment by way of example only and without limitation to the combination of features necessary for carrying the invention into effect. The headings provided are not meant to be limiting of the various embodiments of the invention. Terms such as "comprises", "comprising", "comprise", "includes", "including" and "include" are not meant to be limiting. In addition, the use of the singular includes the plural, and "or" means "and/or" unless otherwise stated. Unless otherwise defined herein, all technical and scientific terms used herein have the same meaning as commonly understood by one of ordinary skill in the art.

Modified Beta-Glucosidases

The term "beta-glucosidase" is intended as described by Bhatia et al. (2002). Beta-glucosidase (3.2.1.21) enzymes transfer a glycosyl group between oxygen nucleophiles, generally resulting in the hydrolysis of a beta-glucosidic bond linking carbohydrate residues in aryl-, amino-, alkyl-beta-D-glucosides, cyanogenic-glucosides, short chain oligosaccharides and disaccharides. In oligosaccharides containing more than two glucosides, beta-glucosidase activity decreases as chain length increases. Beta-glucosidases hydrolyze beta-1,4-glucosidic bonds via a double displacement reaction, resulting in a net retention of anomeric configuration. Two acidic amino acids, aspartic (D) and/or glutamic (E) acid, are directly involved in substrate catalysis. One of these residues acts as a nucleophile and forms an enzyme-glycosyl intermediate. The other acidic residue acts as an acid-base catalyst. In the *Trichoderma reesei* beta-glucosidase 1, herein referred to as TrCel3A whose amino acid sequence is presented in SEQ ID NO: 1, the asparagine at position 236 serves as the nucleophile and the glutamine at position 447 is the acid-base catalyst.

Beta-glucosidases are a subset of beta-glycosidases belonging to glycoside hydrolase (GH) Families 1 and 3, using the classification system developed by Henrissat and coworkers (Henrissat, B. (1991); Henrissat, B. and Bairoch, A. (1996)). There are currently over 115 GH families that have been identified using this classification system, which are listed in the database of Carbohydrate Active Enzymes (CAZy) (see http://afmb.cnrs-mrs.fr/CAZY/index.html for reference). Family 1 comprises beta-glycosidases from archaebacteria, plants and animals. Beta-glycosidases from some bacteria, mold and yeast belong to Family 3. For the purpose of this invention, a "beta-glycosidase" is therefore defined as any protein that is categorized as a Family 3 glycoside hydrolase according to the CAZy system.

The three dimensional structure of beta-D-glucan exohydrolase, a Family 3 glycosyl hydrolase, was described by Varghese et al. (1999). The structure was of a two domain globular protein comprising a N-terminal $(\alpha/\beta)_8$ TIM-barrel domain and a C-terminal a six-stranded beta-sandwich, which contains a beta-sheet of five parallel beta-strands and one antiparallel beta-strand, with three alpha-helices on either side of the sheet. This structure is likely shared by other Family 3 enzymes.

Figures 1, 11:
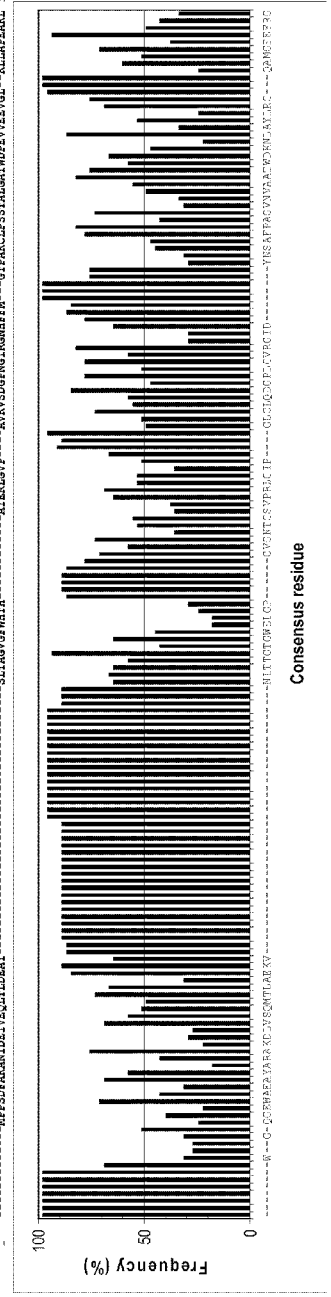
FIG. 11 shows an alignment of the amino acid sequences of 45 fungal Family 3 beta-glucosidases, including the parental TrCel3A of SEQ ID NO: 1, a consensus Family 3 beta-glucosidase sequence, and the % sequence identity of each amino acid sequence to that of TrCel3A. The positions of V43, V101, F260, and I543 are indicated by asterisks (*); the positions of the catalytic amino acids D236 and E447 are indicated by arrows (↓). A graphical representation of the frequency of occurrence of the amino acid at each position of the consensus Family 3 beta-glucosidase sequence of FIG. 11 among the 45 fungal Family 3 beta-glucosidases is provided below the aligned sequences.
Figures 2, 11:
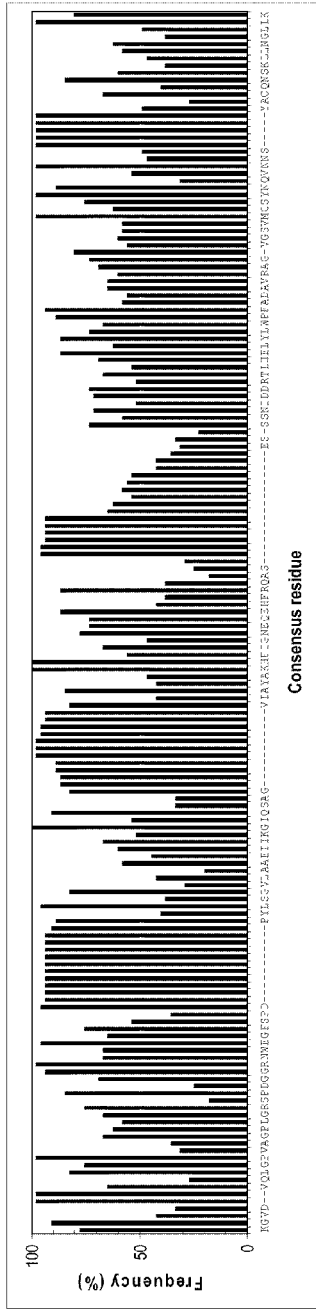
Figure 11:
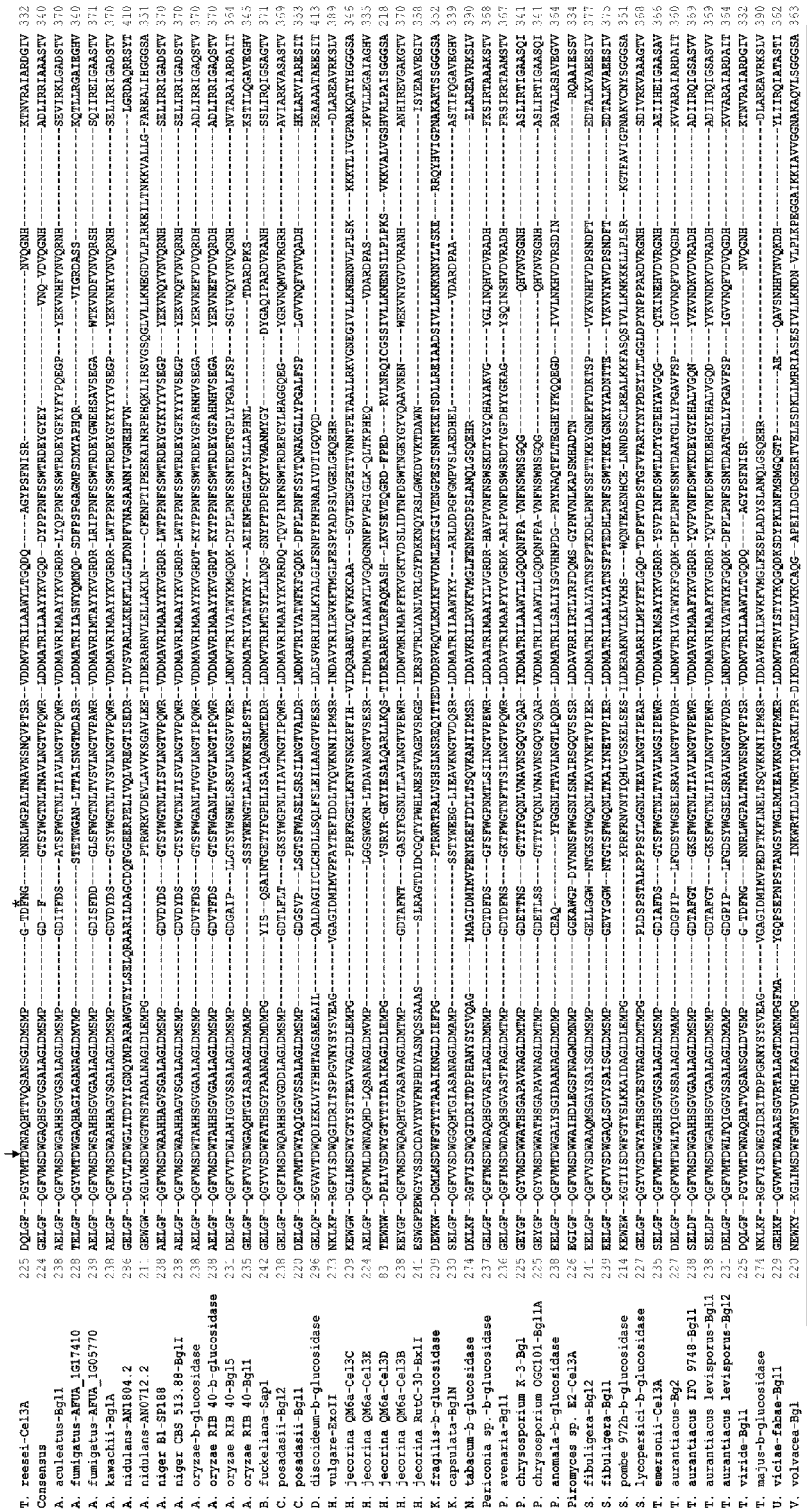
Figure 3:
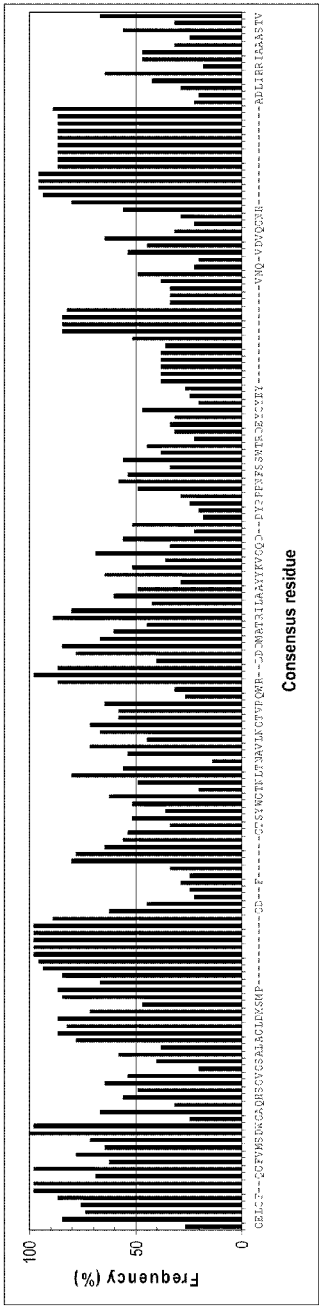
Figures 4, 11:
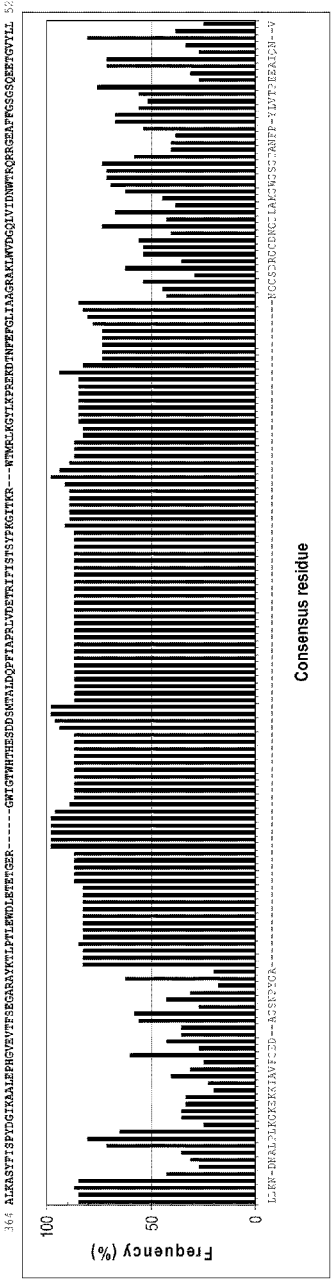
Figures 5, 11:
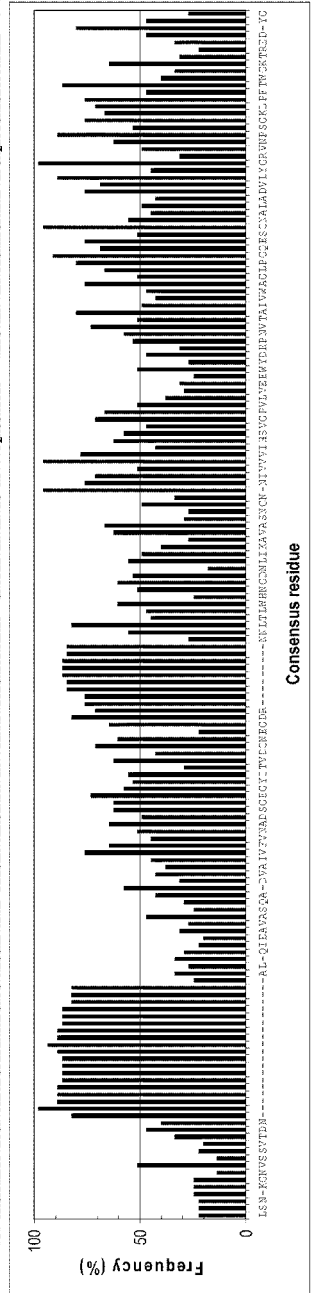
Figures 6, 11:
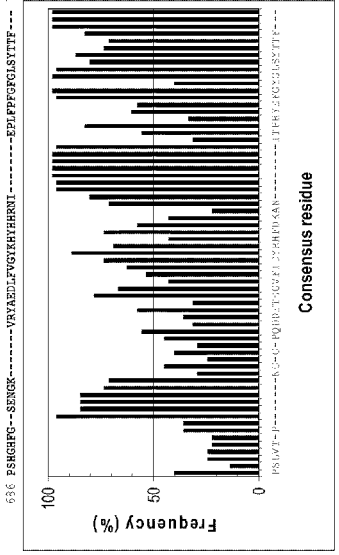

As shown in FIG. 11, the primary amino acid sequence of Family 3 beta-glucosidases show a high degree of similarity. Multiple alignment across 45 Family 3 beta-glucosidase amino acid sequences shows that the most naturally occurring Family 3 beta-glucosidases of fungal origin show from about 40% to about 100% amino acid sequence identity to the amino acid sequence of TrCel3A (FIG. 11). In particular, there are several regions of very high amino acid sequence conservation within the Family 3 beta-glucosidases including, for example, from amino acids 225-256 and 439-459, containing the catalytic amino acids D236 and E447, respectively.

By "TrCel3A beta-glucosidase" or "TrCel3A" it is meant the Family 3 glycosyl hydrolase produced by *Trichoderma reesei* defined by the amino acid sequence of SEQ ID NO: 116. TrCel3A beta-glucosidase is also known as *Trichoderma reesei* beta-glucosidase or BGL1. By "native" or "wild type" TrCel3A (also annotated as TrCel3An, it is meant the TrCel3A of SEQ ID NO: 116 without any amino acid substitutions.

By "modified TrCel3A beta-glucosidase" or "modified TrCel3A", it is meant a TrCel3A beta-glucosidase which comprises one or more of the amino acid substitutions, introduced by genetic engineering techniques, selected from the group consisting of V43X, V101X, F260X, and I543X. For example, the modified TrCel3A beta-glucosidase may comprising one or more amino acid substitutions selected from the group consisting of V43I V43C, V101A, V101G, F260I, F260V, F260Q, F260D, I543N, I543A, I543S, I543G and I543L.

Genetic engineering techniques for altering amino acid sequences include, but are not limited to, site-directed mutagenesis, cassette mutagenesis, random mutagenesis, synthetic oligonucleotide construction, cloning and other genetic engineering techniques as would be known by those of skill in the art (Eijsink V G, et al. 2005). Modified TrCel3A beta-glucosidases of the present invention include those comprising amino acid substitutions at any one of V43X, V101X, F260X and I543X, at any two of V43X, V101X, F260X and I543X, any three of V43X, V101X, F260X and I543X, or all four of V43X, V101X, F260X and I543X.

It will be understood that the modified TrCel3A beta-glucosidase may be derived from wild-type TrCel3A beta-glucosidase of SEQ ID NO: 116 or from a TrCel3A beta-glucosidase that contains other amino acid substitutions. For example, the modified TrCel3A beta-glucosidase may contain amino acid substitution at one or more of positions 66, 73, 96, 235, 248, and 369. Alternatively, after production of the modified TrCel3A beta-glucosidase comprising mutations at one or more of positions 43, 101, 260 and 543, it may be subsequently further modified to contain additional amino acid substitutions, including but not limited to those set forth above.

As used herein in respect of modified TrCel3A beta-glucosidase amino acid sequences, "derived from" refers to the isolation of a target nucleic acid sequence element encoding the desired modified TrCel3A beta-glucosidase using genetic material or nucleic acid or amino acid sequence information specific to the parental TrCel3A beta-glucosidase. As is known by one of skill in the art, such material or sequence information can be used to generate a nucleic acid sequence encoding the desired modified TrCel3A beta-glucosidase using one or more molecular biology techniques including, but not limited to, cloning, sub-cloning, amplification by PCR, in vitro synthesis, and the like.

In one embodiment of the invention, the amino acid sequence of the modified TrCel3A beta-glucosidase is from about 80% to about 99.9% identical to SEQ ID NO: 1 or 116. For example, the amino acid sequence of the modified TrCel3A beta-glucosidase may be from about 80, 81, 82, 83, 84, 85, 86, 87, 88, 89, 90, 91, 92, 93, 94, 95, 96, 97, 98, 99 or 99.9% identical to SEQ ID NO: 1 or 116. In other words, the number of amino acid substitutions in the modified TrCel3A beta-glucosidase may not exceed 20% of the total number amino acids in the parental TrCel3A beta-glucosidase sequence.

In another embodiment of the invention, the amino acid sequence of modified TrCel3A beta-glucosidase may be from about 90% to about 99.9% identical to SEQ ID NO: 1 or 116. For example, the amino acid sequence of the modified TrCel3A beta-glucosidase may be from about 95% to about 100% identical to SEQ ID NO: 1 or 116.

In another embodiment, the amino acid sequence of the modified TrCel3A beta-glucosidase may be from about 80% to about 99.9% identical to SEQ ID NO: 1 or 116 and the modified TrCel3A beta-glucosidase may exhibit (a) at least about a 20% increase in $K_G$, (b) at least about a 20% decrease in $K_{G2}$, or (c) at least about a 10% increase in $k_{cat}$ for cellobiose relative to the $K_G$, $K_G2$ and/or $k_{cat}$ of a parental TrCel3A beta-glucosidase from which it is derived. For example, the modified TrCel3A beta-glucosidase may exhibit (a) from about a 20% to about a 800% increase in $K_G$, or any increase therebetween, (b) from about a 20% to about an 80% decrease in $K_{G2}$, any decrease therebetween, or (c) from about a 10% to about a 50% increase in $k_{cat}$ for cellobiose relative to the $K_G$, $K_G2$ and/or $k_{cat}$ of a parental TrCel3A beta-glucosidase from which is derived.

By "parental TrCel3A beta-glucosidase" or "parental TrCel3A", it is meant a TrCel3A beta-glucosidase that does not contain a substitution of its original amino acid(s) at positions 43, 101, 260 or 543. For example, the parental TrCel3A beta-glucosidase may comprise amino acid substitutions at one or more of positions 66, 72, 96, 235, 248, and 369.

In order to assist one of skill in the art regarding those amino acid positions of the TrCel3A beta-glucosidase at which amino acid substitutions (other than V43X, V101X, F260X, and I543X) may be made and produce an active beta-glucosidase, an alignment of 45 Family 3 beta-glucosidases derived from fungal sources along with a consensus beta-glucosidase sequence consisting of the amino acids that naturally occur with the highest frequency at each position is provided in FIG. 11 along with a graph showing the frequency of occurrence of each amino acid of the consensus sequence at each position. Using the information provided in FIG. 11, one of skill in the art would recognize regions of low sequence conservation to other Family 3 beta-glucosidases and choose such regions for introduction of amino acid substitutions that are not likely to compromise significantly the function of the enzyme. Non-limiting examples of such regions include, for example, the regions between positions 1-20, 303-323 and 403-414 and select amino acid positions within these regions.

As described in more detail herein, several modified TrCel3A beta-glucosidases have been prepared that exhibit (a) at least a 20% increase in $K_G$, (b) at least a 20% decrease in $K_{G2}$, or (c) at least a 10% increase in $k_{cat}$ for cellobiose relative to the $K_G$, $K_{G2}$ and/or $k_{cat}$ of a parental TrCel3A beta-glucosidase from which is derived. A list of several modified TrCel3A beta-glucosidases, which is not to be considered limiting in any manner, is presented in Table 1.

TABLE 1

TrCel3A beta-glucosidases with improved catalytic efficiency

| Modified TrCel3A beta-glucosidase | SEQ ID NO: |
|---|---|
| TrCel3A-V43I | 2 |
| TrCel3A-V43C | 3 |
| TrCel3A-V101A | 4 |
| TrCel3A-V101G | 5 |
| TrCel3A-F260I | 6 |
| TrCel3A-F260V | 7 |
| TrCel3A-F260Q | 8 |

TABLE 1-continued

TrCel3A beta-glucosidases with improved catalytic efficiency

| Modified TrCel3A beta-glucosidase | SEQ ID NO: |
|---|---|
| TrCel3A-F260D | 9 |
| TrCel3A-I543N | 10 |
| TrCel3A-I543W | 11 |
| TrCel3A-I543A | 12 |
| TrCel3A-I543S | 13 |
| TrCel3A-I543G | 14 |
| TrCel3A-I543L | 15 |
| TrCel3A-S72N-V101M-F260I | 16 |
| TrCel3A-V43I-S72N-V101M | 17 |
| TrCel3A-S72N-V101M-I543N | 18 |
| TrCel3A-S72N-V101M-I543D | 19 |
| TrCel3A-S72N-V101M-I543L | 20 |
| TrCel3A-V43I-S72N-V101M-F260I | 21 |
| TrCel3A-V43I-S72N-V101M-F260I-I543N | 22 |
| TrCel3A-V43I-S72N-V101M-I543N | 23 |
| TrCel3A-S72N-V101M-F260I-I543N | 69 |
| TrCel3A-S72N-V101M-F260I-I543L | 70 |
| TrCel3A-V43I full | 117 |
| TrCel3A-V43C full | 118 |
| TrCel3A-V101A full | 119 |
| TrCel3A-V101G full | 120 |
| TrCel3A-F260I full | 121 |
| TrCel3A-F260V full | 122 |
| TrCel3A-F260Q full | 123 |
| TrCel3A-F260D full | 124 |
| TrCel3A-I543N full | 125 |
| TrCel3A-I543W full | 126 |
| TrCel3A-I543A full | 127 |
| TrCel3A-I543S full | 128 |
| TrCel3A-I543G full | 129 |
| TrCel3A-I543L full | 130 |
| TrCel3A-S72N-V101M-F260I full | 131 |
| TrCel3A-V43I-S72N-V101M full | 132 |
| TrCel3A-S72N-V101M-I543N full | 133 |
| TrCel3A-S72N-V101M-I543D full | 134 |
| TrCel3A-S72N-V101M-I543L full | 135 |
| TrCel3A-V43I-S72N-V101M-F260I full | 136 |
| TrCel3A-V43I-S72N-V101M-F260I-I543N full | 137 |
| TrCel3A-V43I-S72N-V101M-I543N full | 138 |
| TrCel3A-S72N-V101M-F260I-I543N full | 139 |
| TrCel3A-S72N-V101M-F260I-I543L full | 140 |

Modified TrCel3A Beta-Glucosidases Improved Kinetic Parameters

The modified TrCel3A beta-glucosidases of the present invention exhibit improvements in at least one of the following kinetic parameters: $K_G$, $K_{G2}$ and $k_{cat}$. $K_G$ is defined as the concentration of glucose which reduces the enzymatic activity of the beta-glucosidase by 50%. $K_{G2}$ is defined as the concentration of cellobiose at which the beta-glucosidase exhibits half its maximal rate. The $k_{cat}$ is the catalytic rate constant for the hydrolysis of cellobiose. Example 8 details an assay for measuring the $K_G$ and $K_{G2}$ of parental and modified TrCel3A beta-glucosidases. Example 9 details an assay for measuring the $k_{cat}$ of parental and modified TrCel3A beta-glucosidases.

$K_G$ of the parental and modified TrCel3A beta-glucosidases can be determined by measuring the rate of hydrolysis of a chromogenic substrate, such as p-nitrophenyl-beta-D-glucopyranoside (pNPG), in the presence of various concentrations of glucose as described in Example 8. The $K_G$ is the concentration of glucose that reduces the rate of p-nitrophenol (pNP) release from pNPG by 50% compared to the rate of pNPG hydrolysis in the absence of glucose. The $K_{G2}$ constants for parental and modified TrCel3A beta-glucosidases can be determined by measuring the rate of hydrolysis of cellobiose in reactions containing increasing concentrations of cellobiose or, alternatively, by measuring the rate of hydrolysis of a chromogenic substrate, such as pNPG, in the presence of various concentrations of a cellobiose as described in Example 8. The $K_{G2}$ is the concentration of cellobiose that reduces the rate of pNP release from pNPG by 50% compared to the rate of pNPG hydrolysis in the absence of cellobiose. The $k_{cat}$ values for parental and modified TrCel3A beta-glucosidases can be determined by measuring the rate of cellobiose hydrolysis at varying concentrations of a cellobiose substrate, for example, as described in Example 9.

Figure 12:
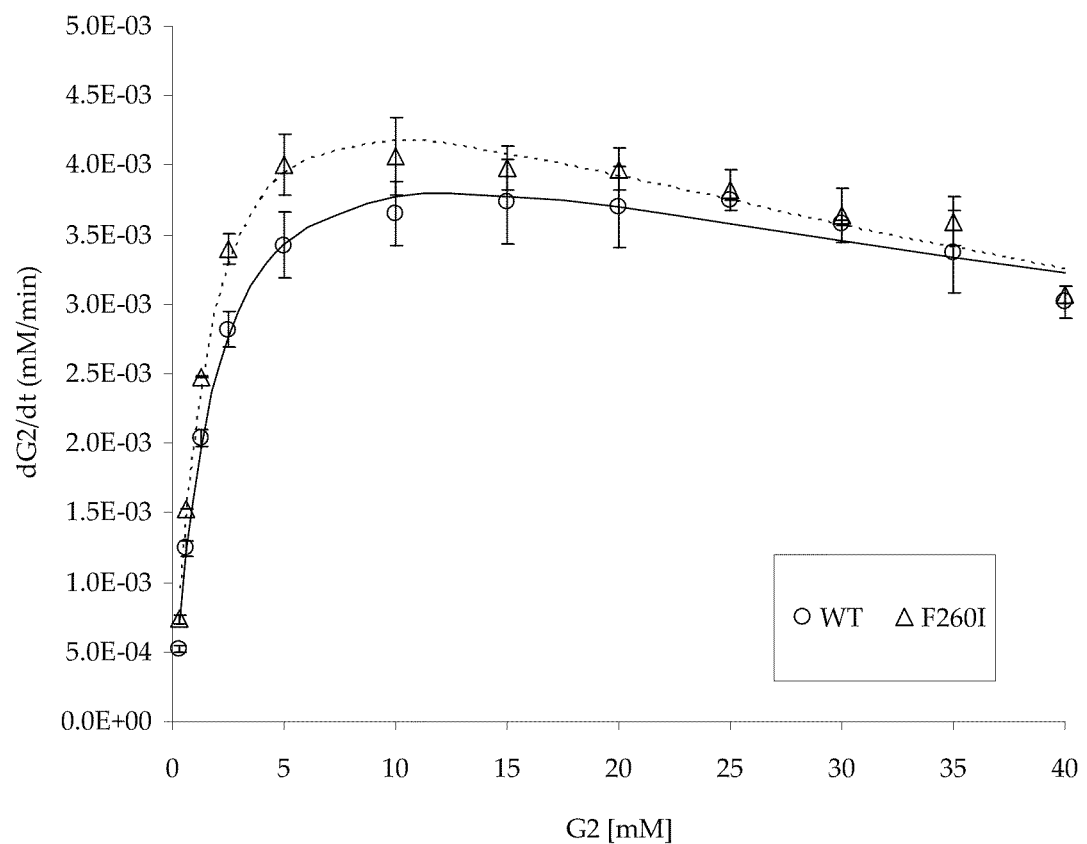
FIG. 12 is a Michaelis-Menton plot comparing the rates of cellobiose hydrolysis by wild-type parental TrCel3A and modified TrCel3A-F260I at different substrate concentrations.

The effect of amino acid substitutions at positions 43, 101, 260 and 543 were determined by a comparative study of the modified and parental TrCel3A beta-glucosidases. The relative values of $K_G$, $K_{G2}$ and $k_{cat}$ for the parental and modified TrCel3A beta-glucosidases are shown in Table 2, below. Reaction curves for the hydrolysis of pNPG substrate alone and in the presence of glucose or cellobiose by parental and modified TrCel3A beta-glucosidases are shown in FIGS. 6 through 10. Reaction curves for the hydrolysis of cellobiose substrate by parental and modified TrCel3A beta-glucosidases are shown in FIG. 12.

TABLE 2

Modified TrCel3A Beta-glucosidases with Improved Kinetic Parameters

| Amino acid substitution | Relative $K_G$ | Relative $K_{G2}$ | Relative $K_G/K_{G2}$ | Relative $k_{cat}$ |
|---|---|---|---|---|
| None (TrCel3A) | 1.00 | 1.00 | 1 | 1 |
| V43I | 0.72 | 0.53 | 1.38 | 0.75 |
| V43C | 7.24 | 2.03 | 3.58 | ND |
| V101A | 0.93 | 0.69 | 1.34 | 0.81 |
| F260I | 1.59 | 1.04 | 1.52 | 1.24 |
| F260D | 1.21 | 1.11 | 1.09 | ND |
| F260Q | 1.19 | 1.14 | 1.05 | ND |
| F260V | 1.24 | 1.08 | 1.14 | ND |
| I543N | 1.50 | 1.18 | 1.27 | 0.73 |
| I543W | 0.97 | 0.81 | 1.20 | 0.51 |
| I543S | 1.09 | 0.92 | 1.19 | 1.09 |
| I543A | 1.17 | 0.98 | 1.19 | 1.00 |
| I543G | 0.93 | 0.86 | 1.08 | 0.90 |
| I543L | 1.05 | 0.96 | 1.10 | 1.29 |
| S72N-V101M-F260I | 0.76 | 0.58 | 1.32 | 0.95 |
| V43I-S72N-V101M | 0.59 | 0.39 | 1.50 | 0.85 |
| S72N-V101M-I543N | 0.74 | 0.54 | 1.37 | 0.87 |
| S72N-V101M-I543D | 0.62 | 0.45 | 1.38 | ND |
| S72N-V101M-I543L | 0.72 | 0.58 | 1.24 | 0.96 |
| V43I-S72N-V101M-F260I | 0.59 | 0.31 | 1.92 | 0.78 |
| S72N-V101M-F260I-I543N | 1.10 | 0.71 | 1.55 | 1.02 |
| V43I-S72N-V101M-F260I-I543N | 0.71 | 0.32 | 2.20 | 0.69 |
| V43I-S72N-V101M-I543N | 0.52 | 0.27 | 1.91 | 0.73 |
| S72N-V101M-F260I-I543L | 0.86 | 0.56 | 1.54 | 1.00 |

Genetic Constructs Encoding Modified TrCel3A Beta-Glucosidases

The present invention also relates to genetic constructs comprising a nucleic acid sequence encoding the modified TrCel3A beta-glucosidase operably linked to regulatory nucleic acid sequences directing the expression and secretion of the modified TrCel3A beta-glucosidase from a host microbe. By "regulatory nucleic acid sequences" it is meant nucleic acid sequences directing the transcription and translation of the modified TrCel3A-encoding nucleic acid sequence and a nucleic acid sequence encoding a secretion signal peptide capable of directing the secretion of the modified TrCel3A beta-glucosidase from a host microbe. The regulatory nucleic acid sequences may be derived from genes that are highly expressed and secreted in the host microbe under industrial fermentation conditions. For example, the regulatory nucleic acid sequences may be derived from any one or more of the *Trichoderma reesei* cellulase or hemicellulase genes.

The genetic construct may further comprise a selectable marker gene to enable isolation of a genetically modified microbe transformed with the construct as is commonly known to those of skill in the art. The selectable marker gene may confer resistance to an antibiotic or the ability to grow on medium lacking a specific nutrient to the host organism that otherwise could not grow under these conditions. The present invention is not limited by the choice of selectable marker gene, and one of skill in the art may readily determine an appropriate gene. For example, the selectable marker gene may confer resistance to hygromycin, phleomycin, kanamycin, geneticin, or G418, or may complement a deficiency of the host microbe in one of the trp, arg, leu, pyr4, pyr, ura3, ura5, his, or ade genes or may confer the ability to grow on acetamide as a sole nitrogen source.

The genetic construct may further comprise other nucleic acid sequences as is commonly known to those of skill in the art, for example, transcriptional terminators, nucleic acid sequences encoding peptide tags, synthetic sequences to link the various other nucleic acid sequences together, origins of replication, and the like. The practice of the present invention is not limited by the presence of any one or more of these other nucleic acid sequences.

Genetically Modified Microbes Expressing Modified TrCel3A Beta-Glucosidases

The modified TrCel3A beta-glucosidase may be expressed and secreted from a genetically modified microbe produced by transformation of a host microbe with a genetic construct encoding the modified TrCel3A beta-glucosidase. The host microbe may be a yeast or a filamentous fungus, particularly those classified as Ascomycota. Genera of yeasts useful as host microbes for the expression of modified TrCel3A beta-glucosidases of the present invention include *Saccharomyces, Pichia, Hansenula, Kluyveromyces, Yarrowia*, and *Arxula*. Genera of fungi useful as microbes for the expression of modified TrCel3A beta-glucosidases of the present invention include *Trichoderma, Hypocrea, Aspergillus, Fusarium, Humicola, Neurospora, Chrysosporium, Myceliophthora, Thielavia, Sporotrichum* and *Penicillium*. For example, the host microbe may be an industrial strain of *Trichoderma reesei*. Typically, the host microbe is one which does not express a parental TrCel3A beta-glucosidase.

The genetic construct may be introduced into the host microbe by any number of methods known by one skilled in the art of microbial transformation, including but not limited to, treatment of cells with $CaCl_2$, electroporation, biolistic bombardment, PEG-mediated fusion of protoplasts (e.g. White et al., WO 2005/093072, which is incorporated herein by reference). After selecting the recombinant fungal strains expressing the modified TrCel3A, the selected recombinant strains may be cultured in submerged liquid fermentations under conditions that induce the expression of the modified TrCel3A.

Production of Modified TrCel3A Beta-Glucosidases

The modified TrCel3A beta-glucosidase of the present invention may be produced in a fermentation process in which a genetically modified microbe comprising a genetic construct encoding the modified TrCel3A beta-glucosidase is grown in submerged liquid culture fermentation.

Submerged liquid fermentations of microorganisms, including *Trichoderma* and related filamentous fungi, are typically conducted as a batch, fed-batch or continuous process. In a batch process, all the necessary materials, with the exception of oxygen for aerobic processes, are placed in a reactor at the start of the operation and the fermentation is allowed to proceed until completion, at which point the product is harvested. A batch process for producing the modified TrCel3A beta-glucosidase of the present invention may be carried out in a shake-flask or a bioreactor.

In a fed-batch process, the culture is fed continuously or sequentially with one or more media components without the removal of the culture fluid. In a continuous process, fresh medium is supplied and culture fluid is removed continuously at volumetrically equal rates to maintain the culture at a steady growth rate.

One of skill in the art is aware that fermentation medium comprises a carbon source, a nitrogen source as well as other nutrients, vitamins and minerals which can be added to the fermentation media to improve growth and enzyme production of the host cell. These other media components may be added prior to, simultaneously with or after inoculation of the culture with the host cell.

For the process for producing the modified TrCel3A beta-glucosidase of the present invention, the carbon source may comprise a carbohydrate that will induce the expression of the modified TrCel3A beta-glucosidase from a genetic construct in the genetically modified microbe. For example, if the genetically modified microbe is a strain of a cellulolytic fungus such as *Trichoderma*, the carbon source may comprise one or more of cellulose, cellobiose, sophorose, xylan, xylose, xylobiose and related oligo- or poly-saccharides known to induce expression of cellulases and beta-glucosidase in such cellulolytic fungi.

In the case of batch fermentation, the carbon source may be added to the fermentation medium prior to or simultaneously with inoculation. In the cases of fed-batch or continuous operations, the carbon source may also be supplied continuously or intermittently during the fermentation process. For example, when the genetically modified microbe is a strain of *Trichoderma*, the carbon feed rate is between 0.2 and 2.5 g carbon/L of culture/h, or any amount therebetween.

The process for producing the modified TrCel3A beta-glucosidase of the present invention may be carried at a temperature from about 20° C. to about 40° C., or any temperature therebetween, for example from about 25° C. to about 37° C., or any temperature therebetween, or from 20, 22, 25, 26, 27, 28, 29, 30, 32, 35, 37, 40° C. or any temperature therebetween.

The process for producing the modified TrCel3A beta-glucosidase of the present invention may be carried out at a pH from about 3.0 to 6.5, or any pH therebetween, for example from about pH 3.5 to pH 5.5, or any pH therebetween, for example from about pH 3.0, 3.2, 3.4, 3.5, 3.7, 3.8, 4.0, 4.1, 4.2, 4.3, 4.4, 4.5, 4.6, 4.7, 4.8, 4.9, 5.0, 5.2, 5.4, 5.5, 5.7, 5.8, 6.0, 6.2, 6.5 or any pH therebetween.

Following fermentation, the fermentation broth containing the modified TrCel3A beta-glucosidase may be used directly, or the modified TrCel3A beta-glucosidase may be separated from the fungal cells, for example by filtration or centrifugation. Low molecular solutes such as unconsumed components of the fermentation medium may be removed by ultrafiltration. The modified TrCel3A beta-glucosidase may be concentrated, for example, by evaporation, precipitation, sedimentation or filtration. Chemicals such as glycerol, sucrose, sorbitol and the like may be added to stabilize the modified TrCel3A beta-glucosidase. Other chemicals, such as sodium benzoate or potassium sorbate, may be added to the modified TrCel3A beta-glucosidase to prevent growth of microbial contamination.

The Use of Modified TrCel3A Beta-Glucosidases

The modified TrCel3A beta-glucosidase of the present invention may be used in the hydrolysis of cellulose or in the production of compounds such as those used in the medical and food industries For use in the enzymatic hydrolysis of cellulose, such as in the production of fermentable sugars from a pretreated lignocellulosic feedstock, the modified TrCel3A beta-glucosidase of the invention may be combined with one or more cellulases to produce a cellulase mixture. In one embodiment of the invention, the modified TrCel3A beta-glucosidase is one of many proteins expressed from a host cell, including, but not limited to, cellulase enzymes. The one or more cellulases in the cellulase enzyme mixture and the modified TrCel3A beta-glucosidase may be secreted from a single genetically modified microbe or by different microbes in combined or separate fermentations. Similarly, the one or more cellulases in the cellulase enzymes mixture with which the modified TrCel3A beta-glucosidase may be combined may be expressed individually or in sub-groups from different strains of different organisms and the enzymes combined to make the cellulase enzyme mixture. It is also contemplated that the enzyme mixture may be expressed individually or in sub-groups from different strains of a single organism, such as from different strains of *Saccharomyces, Pichia, Hansenula Trichoderma, Hyprocrea, Aspergillus, Fusarium, Humicola, Chrysosporium, Myceliophthora, Thielavia, Sporotrichum* or *Neurospora*, and the enzymes combined to make the cellulase enzyme mixture. Preferably, all of the enzymes are expressed from a single host organism, such as a strain of cellulolytic fungus belonging to a species of *Trichoderma, Hyprocrea, Aspergillus, Fusarium, Humicola, Chrysosporium, Myceliophthora, Thielavia, Sporotrichum* or *Neurospora*.

It is further contemplated that the cellulase mixture may comprise two or more of such modified beta-glucosidases as described here in, each with a unique set of improved kinetic parameters. Such a cellulase mixture would be expected to maintain a constant beta-glucosidase activity across a broad range of conditions. For example, a cellulase mixture may comprise one modified TrCel3A beta-glucosidase with low substrate affinity and low product inhibition (i.e., higher values of $K_{G2}$ and $K_G$ than the parental beta-glucosidase) and one modified TrCel3A beta-glucosidase with high substrate affinity and high product inhibition (i.e., lower values of $K_{G2}$ and $K_G$ than the parental beta-glucosidase). Such a cellulase mixture would exhibit a near level apparent beta-glucosidase activity across a wide range of cellobiose and glucose concentrations. Many possible combinations of two or more beta-glucosidase enzymes might be envisioned to maintain a constant activity across a variety of conditions that could occur across many different processes and applications.

A pretreated lignocellulosic feedstock is a material of plant origin that, prior to pretreatment, contains at least 20% cellulose (dry weight), more preferably greater than about 30% cellulose, even more preferably greater than 40% cellulose, for example 20, 22, 24, 26, 28, 30, 32, 34, 36, 38, 40, 42, 44, 46, 48, 50, 55, 60, 65, 70, 75, 80, 85, 90% or any percent therebetween, and at least 10% lignin (dry wt), more typically at least 12% (dry wt) and that has been subjected to physical and/or chemical processes to make the fiber more accessible and/or receptive to the actions of cellulolytic enzymes. After pretreatment, the lignocellulosic feedstock may contain higher levels of cellulose. For example, if acid pretreatment is employed, the hemicellulose component is hydrolyzed, which increases the relative level of cellulose. In this case, the pretreated feedstock may contain greater than about 20% cellulose and greater than about 12% lignin.

Lignocellulosic feedstocks that may be used in the invention include, but are not limited to, agricultural residues such as corn stover, wheat straw, barley straw, rice straw, oat straw, canola straw, sugarcane straw and soybean stover; fiber process residues such as corn fiber, sugar beet pulp, pulp mill fines and rejects or sugar cane bagasse; forestry residues such as aspen wood, other hardwoods, softwood, and sawdust; or grasses such as switch grass, miscanthus, cord grass, and reed canary grass. The lignocellulosic feedstock may be first subjected to size reduction by methods including, but not limited to, milling, grinding, agitation, shredding, compression/expansion, or other types of mechanical action. Size reduction by mechanical action can be performed by any type of equipment adapted for the purpose, for example, but not limited to, a hammer mill.

The enzymatic hydrolysis of cellulose using a cellulase enzyme mixture, as defined above, comprising the modified TrCel3A beta-glucosidase may be batch hydrolysis, continuous hydrolysis, or a combination thereof. The hydrolysis may be agitated, unmixed, or a combination thereof.

The enzymatic hydrolysis may be carried out at a temperature of about 30° C. to about 80° C., or any temperature therebetween, for example a temperature of 30, 35, 40, 45, 50, 55, 60, 65, 70, 75° C., 80° C. or any temperature therebetween, and a pH of about 3.0 to about 8.0, or any pH therebetween, for example at a pH of 3.0, 3.5, 4.0, 4.5, 5.0, 5.5, 6.0, 6.5, 7.0, 7.5, 8.0 or pH therebetween. The initial concentration of cellulose in the hydrolysis reactor, prior to the start of hydrolysis, is preferably about 2% (w/w) to about 15% (w/w), or any amount therebetween, for example 2, 4, 6, 8, 10, 12, 14, 15% or any amount therebetween.

The dosage of the cellulase enzyme mixture comprising the modified TrCel3A beta-glucosidase may be about 0.1 to about 100 mg protein per gram cellulose, or any amount therebetween, for example 0.1, 0.5, 1, 5, 10, 15, 20, 25, 30, 40, 50, 60, 70, 80, 90, 100 mg protein per gram cellulose or any amount therebetween. The hydrolysis may be carried out for a time period of about 1 hours to about 200 hours, or any time therebetween; for example, the hydrolysis may be carried out for a period of 15 hours to 100 hours, or any time therebetween, or it may be carried out for 1, 2, 4, 8, 12, 15, 20, 25, 30, 35, 40, 45, 50, 55, 60, 65, 70, 75, 80, 85, 90, 95, 100, 120, 140, 160, 180, 200 or any time therebetween. It should be appreciated that the reaction conditions are not meant to limit the invention in any manner and may be adjusted as desired by those of skill in the art.

In practice, the enzymatic hydrolysis is typically carried out in a hydrolysis reactor. The enzyme mixture is added to the pretreated lignocellulosic feedstock (also referred to as the "substrate") prior to, during, or after the addition of the substrate to the hydrolysis reactor.

Modified Family 3 Beta-Glycosidases

Beta-glucosidases are just one or several classes of hydrolytic enzymes belong to glycoside hydrolase Family 3. For example, Family 3 includes other enzymes that catalyse the hydrolysis of beta-glycosidic bonds such as xylan 1,4-beta-xylosidase (EC 3.2.1.37), beta-N-acetylhexosaminidase (EC 3.2.1.52), glucan 1,3-beta-glucosidase (EC 3.2.1.58), and glucan 1,4-beta-glucosidase (EC 3.2.1.74). For the purposes of the present invention, a "Family 3 beta-glycosidase" is any xylan 1,4-beta-xylosidase (EC 3.2.1.37), beta-N-acetylhexosaminidase (EC 3.2.1.52), glucan 1,3-beta-glucosidase (EC 3.2.1.58), and glucan 1,4-beta-glucosidase (EC 3.2.1.74) that is classified as a Family 3 glycoside hydrolase under the CAZy system (see URL afmb.cnrs-mrs.fr/CAZY/index.html for reference).

By "modified Family 3 beta-glycosidase", it is meant a Family 3 beta-glycosidase which comprises one or more of the amino acid substitutions, introduced by genetic engineering techniques, selected from the group consisting of V43I, V43C, V101A, V101G, F260I, F260V, F260Q, F260D, I543N, I543A, I543S, I543G and I543L (TrCel3A numbering) and which amino acid sequence is at least 80% identical to the amino acid sequence of the parental Family 3 beta-glycosidase from which it is derived For example, the amino acid sequence of the modified Family 3 beta-glycosidase may be from about 80, 81, 82, 83, 84, 85, 86, 87, 88, 89, 90, 91, 92, 93, 94, 95, 96, 97, 98, 99 or 99.9% identical to the amino acid sequence of the parental Family 3 beta-glycosidase from which it is derived.

Sequence identity can be readily determined by alignment of the amino acids of the two sequences, either using manual alignment, or any sequence alignment algorithm as known to one of skill in the art, for example but not limited to, BLAST algorithm (BLAST and BLAST 2.0; Altschul et al., 1997 and 1990), the algorithm disclosed by Smith & Waterman (1981), by the homology alignment algorithm of Needleman & Wunsch (1970), by the search for similarity method of Pearson & Lipman (1988), by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection. An alignment of 45 Family 3 beta-glycosidase sequences is provided in FIG. 11.

It will be understood that the modified Family 3 beta-glycosidase may be derived from wild-type Family 3 beta-glycosidase or from a Family 3 beta-glycosidase that contains other amino acid substitutions. Alternatively, after production of the modified Family 3 beta-glycosidase comprising mutations selected from the group consisting of V43I, V43C, V101A, V101G, F260I, F260V, F260Q, F260D, I543N, I543A, I543S, I543G and I543L, it may be subsequently further modified to contain additional amino acid substitutions, including but not limited to those set forth above.

By "TrCel3A numbering" it is meant the numbering corresponding to the position of amino acids based on the amino acid sequence of TrCel3A (SEQ ID NO: 116) based on alignment of the amino acid sequence of the Family 3 beta-glycosidase with the TrCel3A amino acid sequence. An example of the alignment of 44 other Family 3 beta-glycosidase amino acid sequences with the TrCel3A beta-glucosidase amino acid sequence is provided in FIG. 11.

As used herein in respect of modified Family 3 beta-glycosidase amino acid sequences, "derived from" refers to the isolation of a target nucleic acid sequence element encoding the desired modified Family 3 beta-glycosidase using genetic material or nucleic acid or amino acid sequence information specific to the corresponding parental Family 3 beta-glycosidase. As is known by one of skill in the art, such material or sequence information can be used to generate a nucleic acid sequence encoding the desired modified Family 3 beta-glycosidase using one or more molecular biology techniques including, but not limited to, cloning, sub-cloning, amplification by PCR, in vitro synthesis, and the like.

In one embodiment of the invention of the invention, the amino acid sequence of the modified Family 3 beta-glycosidase is from about 80% to about 99.9% identical to the amino acid sequence of the parental Family 3 beta-glycosidase from which it is derived. For example, the amino acid sequence of the Family 3 beta-glycosidase may be from about 80, 81, 82, 83, 84, 85, 86, 87, 88, 89, 90, 91, 92, 93, 94, 95, 96, 97, 98, 99 or 99.9% identical to the amino acid sequence of the parental Family 3 beta-glycosidase from which it is derived. In other words, the number of amino acid substitutions in the modified Family 3 beta-glycosidase does not exceed 20% of the total number amino acids in the parental Family 3 beta-glycosidase sequence.

The modified Family 3 beta-glycosidase of the present invention exhibit improvements in at least on of the following kinetic parameters: $K_P$, $K_S$ and $k_{cat}$. $K_P$ is defined as the concentration of product which reduces the enzymatic activity of the Family 3 beta-glycosidase by 50%. $K_S$ is defined as the concentration of substrate at which the Family 3 beta-glycosidase exhibits half its maximal rate. The $k_{cat}$ is the catalytic rate constant for the hydrolysis of substrate.

In another embodiment of the invention, the amino acid sequence of the modified Family 3 beta-glycosidase is from about 90% to about 99.9% identical to the amino acid sequence of the parental Family 3 beta-glycosidase from which it is derived. For example, the amino acid sequence of the modified Family 3 beta-glycosidase may be from about 95% to about 100% identical to SEQ ID NO: 1.

In another embodiment, the amino acid sequence of the modified Family 3 beta-glycosidase may be from about 80% to about 99.9% identical to the amino acid sequence of the parental Family 3 beta-glycosidase from which it is derived, and the modified Family 3 beta-glycosidase may exhibit (a) an increase in the $K_P$, (b) a decrease in $K_S$, or (c) an increase in $k_{cat}$ relative to the $K_P$, $K_S$ and/or $k_{cat}$ of a parental Family 3 beta-glycosidase from which is derived.

By "parental Family 3 beta-glycosidase", it is meant a Family 3 beta-glycosidase that does not contain:
isoleucine or cysteine at position 43,
alanine or glycine at position 101;
isoleucine, valine, glutamine, aspartic acid at position 260; or
asparagine, alanine, serine, glycine or leucine at position 543.

The modified Family 3 beta-glycosidase may be derived from a parental Family 3 beta-glycosidase that comprises one or more naturally-occurring amino acid(s) at the substituted positions corresponding to that of the modified Family 3 beta-glycosidase, but that is otherwise identical to the modified Family 3 beta-glycosidase, for example a native Family 3 beta-glycosidase from *A. nidulans*—AN1804.2, *B. fuckeliana*, *T. aurantiacus levisporus*. The parental Family 3 beta-glycosidase may contain one or more amino acid substitutions at other positions, given that these substitutions are also present in the corresponding modified Family 3 beta-glycosidase. Family 3 beta-glycosidases suitable as parental beta-glycosidases from which modified Family 3 beta-glycosidases may be derived are provided in Table 3.

TABLE 3

Family 3 beta-glycosidases

| Organism | Protein | GenPept Accession Number | SEQ ID NO: | Identity with aa of TrCel3A (%) |
|---|---|---|---|---|
| *Aspergillus aculeatus* F-50 | b-glucosidase 1 (Bgl1) | BAA10968.1 | 141 | 4.1 |
| *Aspergillus fumigatus* Af293 | b-glucosidase (AFUA_1G17410; Afu1g17410) | EAL91070.1 | 142 | 5.2 |
| *Aspergillus fumigatus* Af293 | b-glucosidase (AFUA_1G05770; Afu1g05770) | EAL88289.1 | 143 | 3.1 |

TABLE 3-continued

Family 3 beta-glycosidases

| Organism | Protein | GenPept Accession Number | SEQ ID NO: | Identity with aa of TrCel3A (%) |
|---|---|---|---|---|
| Aspergillus kawachii ifo4308 | b-glucosidase (Bg1A) | BAA19913.1 | 144 | 2.6 |
| Aspergillus nidulans FGSC A4 | b-glucosidase (AN1804.2) | EAA64969.1 | 76 | 3.2 |
| Aspergillus nidulans FGSC A4 | b-glucosidase (AN0712.2) | EAA65189.1 | 145 | 9.4 |
| Aspergillus niger B1 | b-glucosidase/tannase (Bgl1; BG3; BGs; SP188) | CAB75696.1 | 146 | 2.8 |
| Aspergillus niger CBS 513.88 | An18g03570 (Bgl1) | CAK48740.1 | 147 | 2.6 |
| Aspergillus oryzae | b-glucosidase | CAD67686.1 | 148 | 2.2 |
| Aspergillus oryzae RIB 40 | b-glucosidase (AO090009000356) | BAE54829.1 | 149 | 2.3 |
| Aspergillus oryzae RIB 40 | b-glucosidase 5 (Bgl5; AO090001000544) | BAE57053.1 | 150 | 3.4 |
| Aspergillus oryzae RIB 40 | b-glucosidase 1 (Bgl1; AO090003001511) | BAE58551.1 | 151 | 1.6 |
| Botryotinia fuckeliana | b-glucosidase (Sap1) | CAB61489.1 | 152 | 5.9 |
| Coccidioides posadasii C735 | b-glucosidase/exo-b-1,3-glucosidase (Bgl2) | AAF21242.1 | 153 | 1.4 |
| Coccidioides posadasii C735 | b-glucosidase (Bgl1) | AAB67972.1 | 154 | 0.4 |
| Dictyostelium discoideum Ax3 | b-glucosidase | AAA74233.1 | 155 | 6.6 |
| Hordeum vulgare | exo-1,3-glucanase II (EII; ExoII) | AAC49170.1 | 156 | 9.5 |
| Hypocrea jecorina QM6a | Cel3c-Cel3C | AAP57756.1 | 157 | 9.4 |
| Hypocrea jecorina QM6a | Cel3e-Cel3E | AAP57760.1 | 158 | 6.5 |
| Hypocrea jecorina QM6a | Cel3d (fragment)-Cel3D | AAP57759.1 | 159 | 2.8 |
| Hypocrea jecorina QM6a | b-glucosidase-Cel3B | AAP57755.1 | 160 | 1.5 |
| Hypocrea jecorina RutC-30 | b-xylosidase (Bxl1) | CAA93248.1 | 161 | 9.2 |
| Kluyveromyces fragilis | b-glucosidase | CAA29353.1 | 162 | 8.0 |
| Kuraishia capsulata 35M5N | b-glucosidase (BglN) | AAA91297.1 | 163 | 3.0 |
| Nicotiana tabacum | b-glucosidase | BAA33065.1 | 96 | 0.0 |
| Periconia sp. BCC 2871 | b-glucosidase | ABX84365.1 | 164 | 1.9 |
| Phaeosphaeria avenaria WAC1293 | b-glucosidase (Bgl1) | CAB82861.1 | 165 | 2.7 |
| Phanerochaete chrysosporium K-3 | glucan b-1,3-glucosidase (Bgl) | BAB85988.1 | 166 | 2.6 |
| Phanerochaete chrysosporium OGC101 | glucan 1,3-b-glucosidase (CbgL)-Bgl1A | AAC26489.1 | 167 | 2.6 |
| Pichia anomala var. acetaetherius | b-glucosidase | CAA26662.1 | 168 | 6.4 |
| Piromyces sp. E2 | b-glucosidase (Cel3A)-Cel3A | AAO41704.1 | 169 | 8.3 |
| Saccharomycopsis fibuligera | b-glucosidase 2 (Bgl2) | AAA34315.1 | 170 | 8.2 |
| Saccharomycopsis fibuligera | b-glucosidase 1 (Bgl1) | AAA34314.1 | 171 | 8.3 |
| Schizosaccharomyces pombe 972h- | b-glucosidase (SPBC1683.04) | CAB91166.1 | 172 | 7.4 |
| Septoria lycopersici | b-glucosidase (tomatinase; B2Tom) | AAB08445.1 | 173 | 7.2 |
| Talaromyces emersonii | b-glucosidase-Cel3A | AAL69548.3 | 174 | 3.2 |
| Thermoascus aurantiacus | b-glucosidase (Bg2; BGII) | AAY33982.1 | 175 | 5 |
| Thermoascus aurantiacus IFO 9748 | b-glucosidase (Bgl1; Bg1) | AAZ95587.1 | 176 | 4.3 |
| Thermoascus aurantiacus var. levisporus | b-1,4-glucosidase (Bgl1) | ABX79552.1 | 177 | 4.3 |
| Thermoascus aurantiacus var. levisporus | b-1,4-glucosidase (Bgl2) | ABX56926.1 | 178 | 5 |
| Trichoderma viride AS 3.3711 | b-D-glucoside glucohydrolase (Bgl1) | AAQ76093.1 | 179 | 8.3 |
| Tropaeolum majus | b-glucosidase | CAA07070.1 | 180 | 0.3 |
| Uromyces viciae-fabae | b-glucosidase (Bgl1) | CAE01320.1 | 181 | 9.8 |
| Volvariella volvacea V14 | b-glucosidase (Bgl; BGL-II) | AAG59831.1 | 182 | 8.8 |

EXAMPLES

The present invention will be further illustrated in the following examples. However, it is to be understood that these examples are for illustrative purposes only and should not be used to limit the scope of the present invention in any manner.

Example 1 describes the strains and vectors used in the following examples. Example 2 describes the cloning of the TrCel3A gene and transformation in yeast. Example 3 summarizes the preparation of the error prone-PCR and site-saturation mutagenesis libraries of TrCel3A. Example 4 describes the selection and expression of wild-type and modified TrCel3A beta-glucosidases from microculture. Example 5 describes the high-throughput screening assays to identify modified TrCel3A beta-glucosidases with improved kinetic parameters. Example 6 describes the construction of modified TrCel3A beta-glucosidases comprising multiple amino acid substitutions. Example 7 describes the expression and purification of wild-type and modified TrCel3A beta-glucosidases from large scale flask cultures. Example 8 describes the measurement of the $K_G$ and $K_{G2}$ of modified and native TrCel3A beta-glucosidases and the calculation of kinetic parameters. Example 9 describes the measurement and calculation of $k_{cat}$ for wild-type and modified TrCel3A beta-glucosidases. Example 10 describes the construction of genetically modified Trichoderma reesei strains expressing cellulase mixtures comprising modified TrCel3A beta-glucosidases and the production of such cellulase mixtures in submerged liquid culture fermentation. Example 11 describes the hydrolysis of pretreated lignocellulosic substrates with cellulase mixtures comprising parental and modified TrCel3A beta-glucosidases.

Example 1

Strains and Vectors

*Saccharomyces cerevisiae* strain BJ3505 (pep4::HIS3 prb-Δ1.6R HIS3 lys2-208 trp1-Δ101 ura3-52 gal2 can1) was obtained from Sigma and was a part of the Amino-Terminal Yeast FLAG Expression Kit. The YEp352/PGK91-1 vector was obtained from the National Institute of Health. The pGEM T-easy vector was obtained from Promega. The vector pC/XBG1-TV is described in U.S. Pat. No. 6,105,703.

Example 2

Cloning of the TrCel3A Gene into YEp352/PGK91-1 and Transformation in Yeast

The TrCel3A gene (SEQ ID NO: 44) contains two introns. One intron is located in the secretion signal at position 323 bp to 391 bp, while the other is located within the gene at position 2152 bp to 2215 bp. The TrCel3A gene contains a unique NheI site located at position 1203 bp. In order to facilitate expression from yeast and cloning using NheI and KpnI restriction enzymes, the unique NheI located within TrCel3A at position 1203 bp and the second intron were removed by a three step PCR. The TrCel3A gene was amplified in three segments from a plasmid containing a genomic subclone of the coding region, including introns, of the mature TrCel3A beta-glucosidase, pC/XBG1-TV using iPROOF DNA polymerase (BioRad). The first fragment (A) was amplified using primers which introduced an NheI site at the 5' end of the gene downstream of the secretion signal (AT048) and which removed the internal NheI site (AT051). The second fragment (B) was amplified using primers which removed the internal NheI site (AT050) and the intron at position 2152 to 2215 bp (AT053). The third fragment (C) was amplified using primers which removed the intron at position 2152 to 2215 bp (AT052) and introduced a KpnI site at the 3' end of the gene, downstream of the stop codon (AT049). Gene products B and C were joined together (to make gene product D) using PCR with primers AT050 and AT049. Gene product D was joined with gene product A using PCR with primers AT048 and AT049 to obtain TrCel3A without introns and with unique NheI and KpnI sites at the 5' and 3' ends, respectively. The final gene product was cloned into the pGEM T-easy vector (Promega) as per the manufacturer's instructions to make plasmid pGEM-TrCel3A. Primer sequences are shown below:

```
                                         (SEQ ID NO: 24)
AT048: 5' CGC CAG GCT AGC GTT GTA CCT CCT GC (SEQ ID NO: 25)
AT049: 5' CTG AGG GTA CCG CTA CGC TAC CGA C (SEQ ID NO: 26)
AT050: 5' CCC GCT AGT ATT GCC GTC GTT GGA TC (SEQ ID NO: 27)
AT051: 5' CCA ACG ACG GCA ATA CTA GCG GGC TTC (SEQ ID NO: 28)
AT052: 5' GTT CGG CTA TGG ACT GTC TTA CAC CAA GTT
CAA CTA C (SEQ ID NO: 29)
AT053: 5' GTT GAA CTT GGT GTA AGA CAG TCC ATA GCC
GAA CTC
```

Preparation of YEp352/PGK91-1/α$_{ss}$TrCel3A was conducted as follows. A DNA adapter containing NheI, KpnI, and EcoRI restriction sites was prepared by annealing primers AT046 and AT047 together. The adapter was inserted into a YEp based-plasmid containing the pgk1 promoter, alpha mating factor secretion signal, and pgk1 terminator sequences to make plasmid YEp352/PGK91-1/α$_{ss}$NKE. Specifically, the adapter was inserted as an NheI/EcoRI fragment into the NheI and EcoRI sites located downstream of the alpha mating factor secretion signal and upstream of the pgk1 terminator. Primer sequences are shown below:

```
                                         (SEQ ID NO: 30)
AT046: 5' CTA GCT GAT CAC TGA GGT ACC G (SEQ ID NO: 31)
AT047: 5' AAT TCG GTA CCT CAG TGA TCA G
```

Plasmid pGEM-TrCel3A was digested with NheI and EcoRI to release the 2235 bp TrCel3A gene. The fragment was purified and ligated into the NheI and EcoRI sites of YEp352/PGK91-1/α$_{ss}$NKE to obtain YEp352/PGK91-1/α$_{ss}$TrCel3A. The resulting vector YEp352/PGK91-1/α$_{ss}$-TrCel3A was transformed in yeast strain BJ3505 using the procedure described by Gietz, R. D. and Woods, R. A. (2002).

Preparation of YEp352/PGK91-1/α$_{ss}$6H-TrCel3A was conducted as follows. A DNA adapter containing SpeI, NheI, KpnI, and EcoRI restriction sites was prepared by annealing primers AT044 and AT045 together. The adapter contains sequences coding for six histidine residues downstream of the SpeI site and upstream of the NheI site. The adapter was inserted into a YEp based-plasmid containing the pgk1 promoter, alpha mating factor secretion signal, and pgk1 terminator sequences to make plasmid YEp352/PGK91-1/α$_{ss}$6HNKE. Specifically, the adapter was inserted as an NheI/EcoRI fragment into the NheI and EcoRI sites located downstream of the alpha mating factor secretion signal and upstream of the pgk1 terminator. Primer sequences are shown below:

```
                                         (SEQ ID NO: 32)
AT044: 5' CTA GTC ATC ACC ATC ACC ATC ACG CTA GCT
GAT CAC TGA GGT ACC G (SEQ ID NO: 33)
AT045: 5' AAT TCG GTA CCT CAG TGA TCA GCT AGC GTG
ATG GTG ATG GTG ATG A
```

Plasmid pGEM-TrCel3A was digested with NheI and EcoRI to release the 2235 bp TrCel3A gene. The fragment was purified and ligated into the NheI and EcoRI sites of YEp352/PGK91-1/α$_{ss}$6HNKE to obtain YEp352/PGK91-1/α$_{ss}$6H-TrCel3A. The resulting vector YEp352/PGK91-1/α$_{ss}$6H-TrCel3A (FIG. 1) was transformed in yeast strain BJ3505 using the procedure described by Gietz, R. D. and Woods, R. A. (2002). The vector YEp352/PGK91-1/α$_{ss}$6H-TrCel3A has been deposited with the American Type Culture Collection (ATCC®), 10801 University Boulevard, Manassas, Va. 20110-2209. The deposit was made on Dec. 22, 2010, and was assigned ATCC Deposit No. PTA-11562.

Example 3

Random Mutagenesis of TrCel3A a. Error Prone-PCR

A random mutagenesis library was generated by error-prone PCR using a Mutazyme® II DNA polymerase method.

A series of four independent PCRs was performed using 5, 10, 15, 20 η$_g$ of YEp352/PGK91-1/α$_{ss}$6H-TrCel3A vector and the Mutazyme® II DNA polymerase with primers YαN21 and 3'PGK-term. Annealing temperature was set to 50° C. The amplification was done for 20 cycles. The four PCR products were pooled and diluted to 16 ηg/μL. The YEp352/PGK91-1/α$_{ss}$6H-TrCel3A vector was digested with NheI and KpnI and the empty vector fragment was isolated. This linear fragment and the final amplicon were transformed simultaneously and cloned by in vivo recombination into yeast strain BJ3505 (Butler, T. and Alcalde, M., 2003).

```
                                          (SEQ ID NO: 34)
YαN21: 5'AGC ACA AAT AAC GGG TTA TTG (SEQ ID NO: 35)
3'PGK-term: 5'GCA ACA CCT GGC AAT TCC TTA CC
``` b. Site-Saturation Mutagenesis

Four TrCel3A libraries were created using site-saturation mutagenesis (SSM) with degenerate primers (NNS) targeting amino acid positions V43, V101, F260, and I543. SSM was performed using a two-step PCR method involving megaprimer synthesis followed by PCR-mediated overlap extension. PCR reactions were carried out using the High Fidelity iProof Taq Polymerase (BioRad). YEp352/PGK91-1/α$_{ss}$6H-TrCel3A was used as the template for the V43X, F260X, and I543X libraries, while YEp352/PGK91-1/α$_{ss}$6H-TrCel3A (S72N, F96L, V101M, N369K, A386T) served as the template for the V101X library.

For each SSM library, MegaPrimer A was amplified using the external primer YαN21 with an internal reverse primer, while MegaPrimer B was derived by combining the external primer PGKterm with an internal forward primer. The internal forward primers contained a degenerate codon sequence to introduce random amino acid substitutions within their target sites. The megaprimers were purified using the Wizard® SV Gel and PCR Clean-Up System.

```
                                          (SEQ ID NO: 34)
YαN21: 5'AGC ACA AAT AAC GGG TTA TTG (SEQ ID NO: 35)
PGKterm: 5'GCA ACA CCT GGC CCT TAC C (SEQ ID NO: 36)
V43X-F: 5'TGG AAC GGC GGT CCT TGC NNS GGA AAC ACA
TCT CCG GCC TC (SEQ ID NO: 37)
V43X-R: 5'GCA AGG ACC GCC GTT CCA (SEQ ID NO: 38)
M101X-F: 5'C GGT GAG GAG NNS AAG GCC TCG G (SEQ ID NO: 39)
M101X-R: 5'ATG AAC TGT CCA CGT TCG CGG (SEQ ID NO: 40)
F260X-F: 5'TG TCA ATG CCT GGC ACA GAC NNS AAC GGT
AAC AAT CGG (SEQ ID NO: 41)
F260X-R: 5'GT CTG TGC CAG GCA TTG ACA (SEQ ID NO: 42)
I543X-F: 5'CCC AAT GAC TAT AAC ACT CGC NNS GTT TCC
GGC GGC AGT GAC (SEQ ID NO: 43)
I543X-R: 5'GCG AGT GTT ATA GTC ATT GGG
```

In the second round of PCR, both megaprimers for a given SSM library were allowed to anneal and extend for 10 cycles to generate the final template. The external primers YαN21 and PGKterm were then added for another 25 cycles to amplify the final product, which was subsequently purified using the Wizard® SV Gel and PCR Clean-Up System. Both the purified PCR product and the linearized vector YEp352/PGK91-1α$_{ss}$-6H-TrCel3A (NheI+NruI) were transformed and cloned via in vivo recombination within the BJ3505 yeast strain using the procedure described by Gietz, R. D. and Woods (2002).

Example 4

Selection and Growth of Yeast Strains Expressing Parental and Modified TrCel3A Beta-Glucosidases This example describes the selection and expression of parental (TrCel3A$^{Wt}$) and modified TrCel3A beta-glucosidase from *Saccharomyces cerevisiae* for use in high-throughput screening assays.

Figure 2:
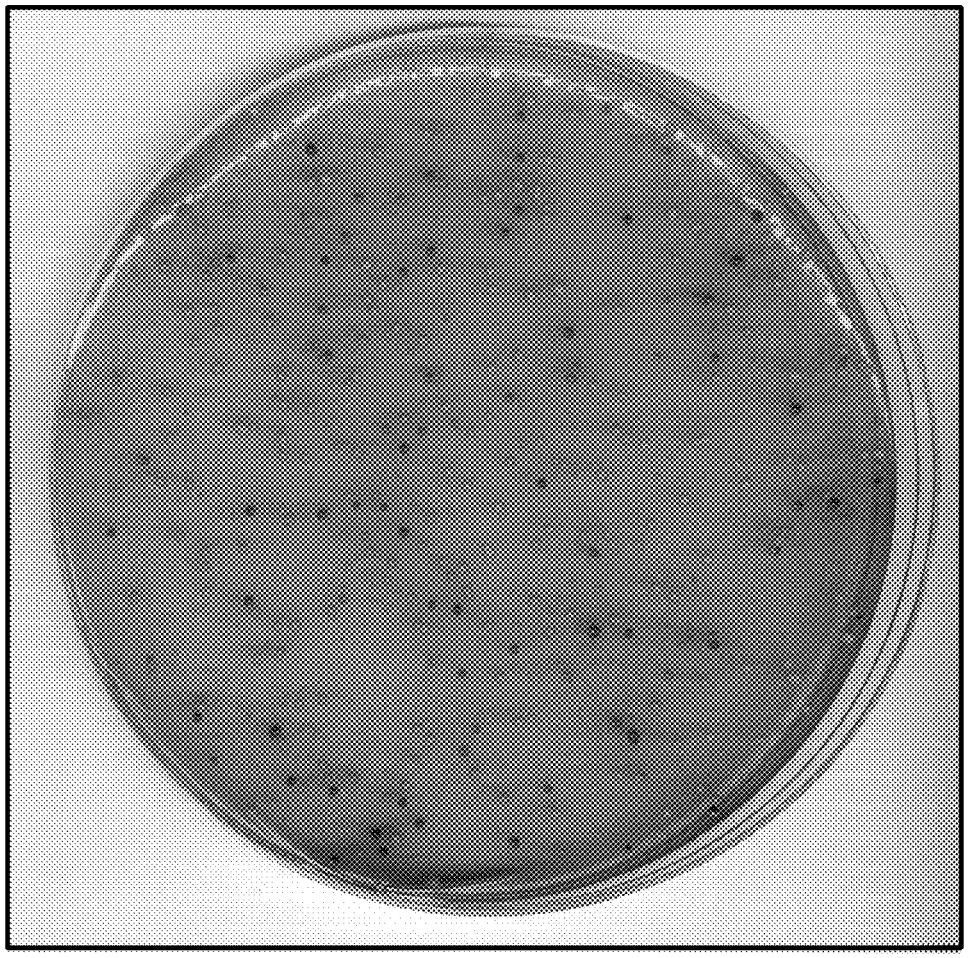
FIG. 2 shows a *Saccharomyces cerevisiae* growth plate containing synthetic complete medium plus 0.1% esculin hydrate and 0.03% FeCl$_3$. Colonies which turned black after incubation for 3-4 days at 30° C. were identified as expressing active TrCel3A beta-glucosidase.

*S. cerevisiae* transformants were grown on plates containing synthetic complete medium (SC: 2% agar w/v, 0.17% yeast nitrogen base w/v, 0.192%-Ura drop-out supplement w/v, 2% glucose w/v, 2% casamino acids w/v, 0.5% ammonium sulfate w/v, pH 5.5) for 3-4 days at 30° C. Each growth plate was replicated by transferring a portion of each colony, using sterilized velvet, to a screen-out plate containing SC medium plus 0.1% esculin hydrate and 0.03% FeCl$_3$. Colonies which turned black after incubation for 3-4 days at 30° C. were identified as expressing active beta-glucosidase (FIG. 2). Colonies were correlated back to their original growth plate and selected for liquid media expression cultures by toothpick inoculation of 1 mL SC media in sterile 96-deep-well plates containing one glass bead (1.5-2.0 mm diameter). Expression cultures were grown for 3 days at 30° C. and 245 rpm with humidity control (New Brunswick Scientific Innova®44 incubator shaker series). Glycerol stocks were prepared by transferring 50 μL of liquid culture to the corresponding wells of a microplate containing 50 μL of 40% glycerol and stored at −80° C. Expression culture plates were centrifuged at 1600×g for 5 minutes to pellet cells and supernatant was aspirated for screening assays (Example 5).

Example 5

Screening of TrCel3A Gene Libraries for Modified TrCel3A Beta-Glucosidases with Higher Catalytic Efficiency This example describes the screening of modified TrCel3A beta-glucosidases for increased higher catalytic efficiency by comparison to parental TrCel3A that had been cloned into *Saccharomyces cerevisiae*.

Figure 3:
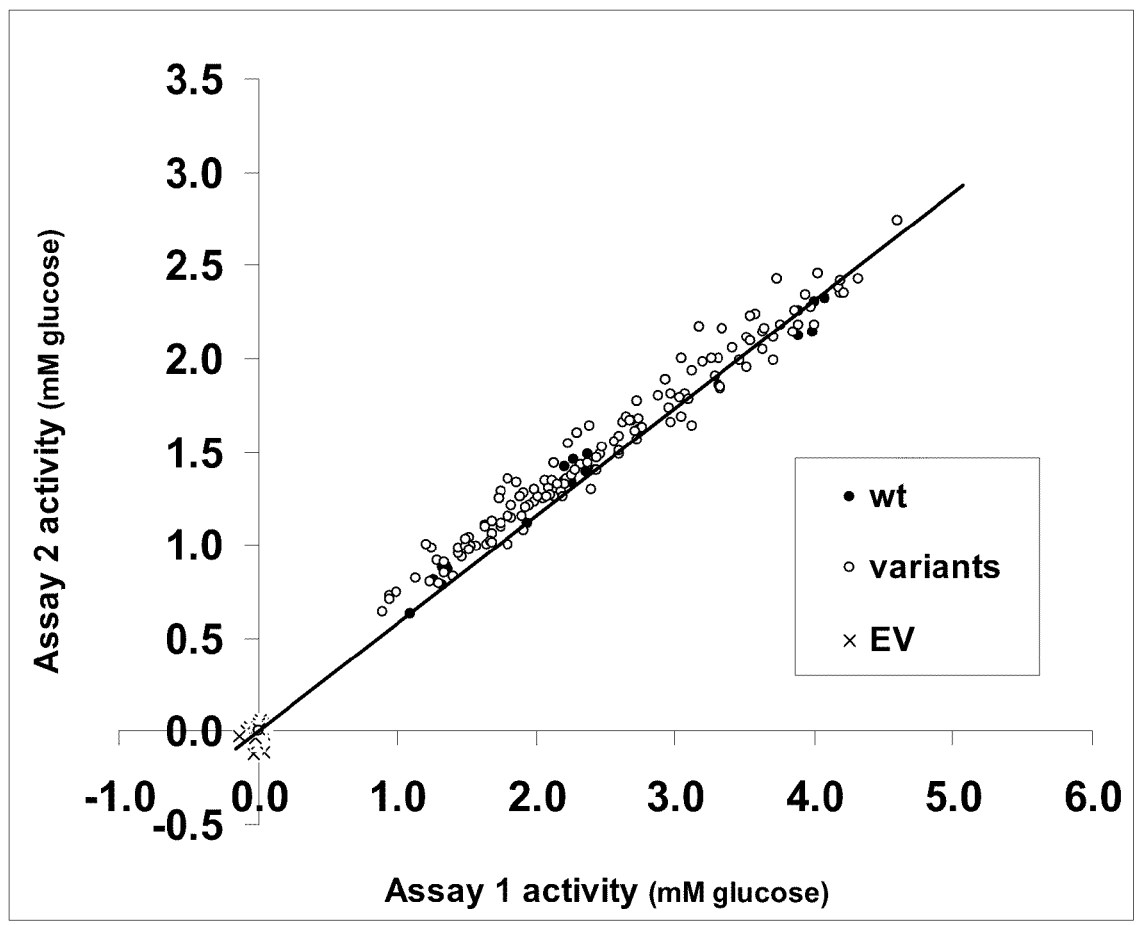
FIG. 3 is a scatter plot of beta-glucosidase activity in assay 1 (30 mM cellobiose) versus beta-glucosidase activity in assay 2 (5 mM cellobiose+1.25 mM glucose). The data relate to the screening of one 96-well culture plate containing wild-type TrCel3A (wt), filtrates from empty vector transformants (EV) and modified TrCel3As (variants). The wild-type TrCel3A data were fit by linear regression in which the y-intercept was fixed to zero.

Modified TrCel3A beta-glucosidases expressed from yeast as described in Example 4 were tested in two 80 μL citrate buffered (pH 5) cellobiose hydrolysis assays using a 96-well PCR plate format. A 40 μL aliquot of supernatant containing a parental or modified TrCel3A beta-glucosidase was incubated with 30 mM cellobiose (Assay 1) and 5.0 mM cellobiose plus 1.25 mM glucose (Assay 2) for 5, 10, 20 and 40 min at 50° C. in an MJ Research Tetrad™2 Peltier Thermal Cycler. Contained in each 96-well PCR plate were six parental TrCel3A controls used for comparison. Enzyme activity was measured through the detection of glucose using a glucose oxidase-peroxidase coupled assay (Trinder P., 1969). Exogenous glucose (1.25 mM) included in Assay 2 was subtracted from the total amount of glucose measured following the incubation. An Assay 2/Assay 1 enzyme activity ratio was calculated for the parental (TrCel3A$^{Wt}$ or Wt) and all modified TrCel3A beta-glucosidases by dividing the enzyme activity in Assay 2 by the enzyme activity in Assay 1. The Assay 2/Assay 1 activity ratio for each modified TrCel3A beta-glucosidase was then compared to that of the average of six parental TrCel3A beta-glucosidase controls on a particular microplate and positives were selected at the 95% confidence level using a t-test. All positive modified TrCel3A beta-glucosidases were produced again in microculture and re-screened to reduce the number of false positives (FIG. 3). Table 4 lists the positive modified TrCel3A beta-glucosidases obtained from screening the error-prone and site-saturation libraries (Example 3) and the Assay 2/Assay 1 enzyme activity ratios compared to the parental, wild-type TrCel3A beta-glucosidase.

TABLE 4

Modified TrCel3A beta-glucosidases selected random libraries.

| Modified TrCel3A | Assay 2/Assay 1 Enzyme Activity Ratio (normalized to TrCel3A$^{Wt}$) |
|---|---|
| Wt | 1.00 |
| V43I | 1.20 |
| V43C | 1.36 |
| V101A | 1.17 |
| V101G | 1.17 |
| F260I | 1.14 |

TABLE 4-continued

Modified TrCel3A beta-glucosidases selected random libraries.

| Modified TrCel3A | Assay 2/Assay 1 Enzyme Activity Ratio (normalized to TrCel3A$^{Wt}$) |
|---|---|
| I543N | 1.12 |
| I543W | 1.26 |
| I543A | 1.23 |
| I543G | 1.22 |
| I543L | 1.21 |
| I543S | 1.25 |

Example 6

Construction and Expression of Modified TrCel3A Beta-Glucosidases with Multiple Amino Acid Substitutions Using YEp352/PGK91-1/α$_{ss}$6H-TrCel3A(S72N-F96L-V101M (U.S. Publication No. 2010/0093040A1) as a template, additional mutations were introduced using a two-step PCR method involving megaprimer synthesis followed by megaprimer PCR using High Fidelity iProof Taq Polymerase (Table 5). The internal primers were modified to introduce the desired amino acid substitutions into the TrCel3A construct. The external plasmid primers (YαN21 and PGKterm) were used to amplify the final product. The megaprimers and final products were purified using the Wizard® SV Gel and PCR Clean-Up System.

TABLE 5

Generation of modified TrCel3A enzymes by PCR.

| PCR | Step | Template | Primer 1 | Primer 2 | Amplicon |
|---|---|---|---|---|---|
| 1 | 1 | YEp352/PGK91-1-α$_{SS}$-6H-TrCel3A(S72N-F96L-V101M) | YαN21 | DK068 | PCR 1 Step 1 |
|   | 1 | YEp352/PGK91-1-α$_{SS}$-6H-TrCel3A(S72N-F96L-V101M) | DK067 | PGK-Term | PCR 1 Step 1 |
|   | 2 | Both PCR 1 Step 1 megaprimers | YαN21 | PGK-Term | TrCel3A(S72N-V101M) |
| 2 | 1 | TrCel3A(S72N-V101M) | YαN21 | DK222 | PCR 2 Step 1 |
|   | 1 | TrCel3A(S72N-V101M) | DK221 | PGK-Term | PCR 2 Step 1 |
|   | 2 | Both PCR 2 Step 1 megaprimers | YαN21 | PGK-Term | TrCel3A(V43I-S72N-V101M) |
| 3 | 1 | TrCel3A(S72N-V101M) | YαN21 | DK106 | PCR 3 Step 1 |
|   | 1 | TrCel3A(S72N-V101M) | DK105 | PGK-Term | PCR 3 Step 1 |
|   | 2 | Both PCR 3 Step 1 megaprimers | YαN21 | PGK-Term | TrCel3A(S72N-V101M-F260I) |
| 4 | 1 | TrCel3A(S72N-V101M) | YαN21 | DK224 | PCR 4 Step 1 |
|   | 1 | TrCel3A(S72N-V101M) | DK223 | PGK-Term | PCR 4 Step 1 |
|   | 2 | Both PCR 4 Step 1 megaprimers | YαN21 | PGK-Term | TrCel3A(S72N-V101M-I543D) |
| 5 | 1 | TrCel3A(S72N-V101M) | YαN21 | DK232 | PCR 5 Step 1 |
|   | 1 | TrCel3A(S72N-V101M) | DK231 | PGK-Term | PCR 5 Step 1 |
|   | 2 | Both PCR 5 Step 1 megaprimers | YαN21 | PGK-Term | TrCel3A(S72N-V101M-I543L) |
| 6 | 1 | TrCel3A(S72N-V101M) | YαN21 | DK230 | PCR 6 Step 1 |
|   | 1 | TrCel3A(S72N-V101M) | DK229 | PGK-Term | PCR 6 Step 1 |
|   | 2 | Both PCR 6 Step 1 megaprimers | YαN21 | PGK-Term | TrCel3A(S72N-V101M-I543N) |
| 7 | 1 | TrCel3A(V43I-S72N-V101M) | YαN21 | DK230 | PCR 7 Step 1 |
|   | 1 | TrCel3A(V43I-S72N-V101M) | DK229 | PGK-Term | PCR 7 Step 1 |
|   | 2 | Both PCR 7 Step 1 megaprimers | YαN21 | PGK-Term | TrCel3A(V43I-S72N-V101M-I543N) |
| 8 | 1 | TrCel3A(S72N-V101M-F260I) | YαN21 | DK222 | PCR 8 Step 1 |
|   | 1 | TrCel3A(S72N-V101M-F260I) | DK221 | PGK-Term | PCR 8 Step 1 |
|   | 2 | Both PCR 8 Step 1 megaprimers | YαN21 | PGK-Term | TrCel3A(V43I-S72N-V101M-F260I) |
| 9 | 1 | TrCel3A(S72N-V101M-F260I) | YαN21 | DK232 | PCR 9 Step 1 |
|   | 1 | TrCel3A(S72N-V101M-F260I) | DK231 | PGK-Term | PCR 9 Step 1 |

TABLE 5-continued

Generation of modified TrCel3A enzymes by PCR.

| PCR | Step | Template | Primer 1 | Primer 2 | Amplicon |
|---|---|---|---|---|---|
|  | 2 | Both PCR 9 Step 1 megaprimers | YαN21 | PGK-Term | TrCel3A(S72N-V101M-F260I-I543L) |
| 10 | 1 | TrCel3A(S72N-V101M-F260I) | YαN21 | DK230 | PCR 10 Step 1 |
|  | 1 | TrCel3A(S72N-V101M-F260I) | DK229 | PGK-Term | PCR 10 Step 1 |
|  | 2 | Both PCR 10 Step 1 megaprimers | YαN21 | PGK-Term | TrCel3A(S72N-V101M-F260I-I543N) |
| 11 | 1 | TrCel3A(S72N-V101M-F260I-I543N) | YαN21 | DK222 | PCR 11 Step 1 |
|  | 1 | TrCel3A(S72N-V101M-F260I-I543N) | DK221 | PGK-Term | PCR 11 Step 1 |
|  | 2 | Both PCR 11 Step 1 megaprimers | YαN21 | PGK-Term | TrCel3A(V43I-S72N-V101M-F260I-I543N) |

To facilitate cloning, the final product was digested with NheI+KpnI and ligated into vector YEp352/PGK91-1/α$_{ss}$6H-TrCel3A linearized with NheI+KpnI. The ligation mix was transformed into DH5a chemically-competent *E. coli* cells, plasmid extracted, and sequenced. Plasmids encoding the modified beta-glucosidases were transformed into yeast strain BJ3505.

```
                                        (SEQ ID NO: 34)
YαN21  5'-AGCACAAATAACGGGTTATTG-3'

(SEQ ID NO: 35)
3'PGKterm  5'-GCAACACCTGGCCCTTACC-3'

(SEQ ID NO: 45)
5'DK067  5'-CGCGAACGTGGACAGTTCATCGGTGAGGAGATG-3'

(SEQ ID NO: 46)
3'DK068  5'-CATCTCCTCACCGATGAACTGTCCACGTTCGCG-3'

(SEQ ID NO: 47)
5'DK105  5'-CAATGCCTGGCACAGACATCAACGGTAACAATC-3'

(SEQ ID NO: 48)
3'DK106  5'-GATTGTTACCGTTGATGTCTGTGCCAGGCATTG-3'

(SEQ ID NO: 49)
5'DK221  5'-GGCGGTCCTTGCATTGGAAACACAT-3'

(SEQ ID NO: 50)
3'DK222  5'-ATGTGTTTCCAATGCAAGGACCGCC-3'

(SEQ ID NO: 51)
5'DK223  5'-GACTATAACACTCGCGACGTTTCCGGCGGCAG-3'

(SEQ ID NO: 52)
3'DK224  5'-CTGCCGCCGGAAACGTCGCGAGTGTTATAGTC-3'

(SEQ ID NO: 53)
5'DK229  5'-GACTATAACACTCGCAACGTTTCCGGCGGCAG-3'

(SEQ ID NO: 54)
3'DK230  5'-CTGCCGCCGGAAACGTTGCGAGTGTTATAGTC-3'

(SEQ ID NO: 55)
5'DK231  5'-GACTATAACACTCGCCTGGTTTCCGGCGGCAG-3'

(SEQ ID NO: 56)
3'DK232  5'-CTGCCGCCGGAAACCAGGCGAGTGTTATAGTC-3'
```

Example 7

Purification of Modified TrCel3A Beta-Glucosidases

Modified TrCel3A beta-glucosidases that passed the selection criteria in Example 5, along with the modified TrCel3A-F260X beta-glucosidases produced by site-saturation mutagenesis at position 260 (Example 4) or by combining two or more amino acid substitutions (Example 6), were purified for further analysis. For each modified TrCel3A beta-glucosidase, 50 mL of sterile YPD medium (10 g/L yeast extract, 20 g/L peptone and 20 g/L glucose) was inoculated with 10 mL of overnight cultures of transformed *Saccharomyces cerevisiae* grown from cells freshly picked from an agar plate. The cultures were then incubated for 96 hours at 30° C. with shaking at 200 rpm.

Figure 4:
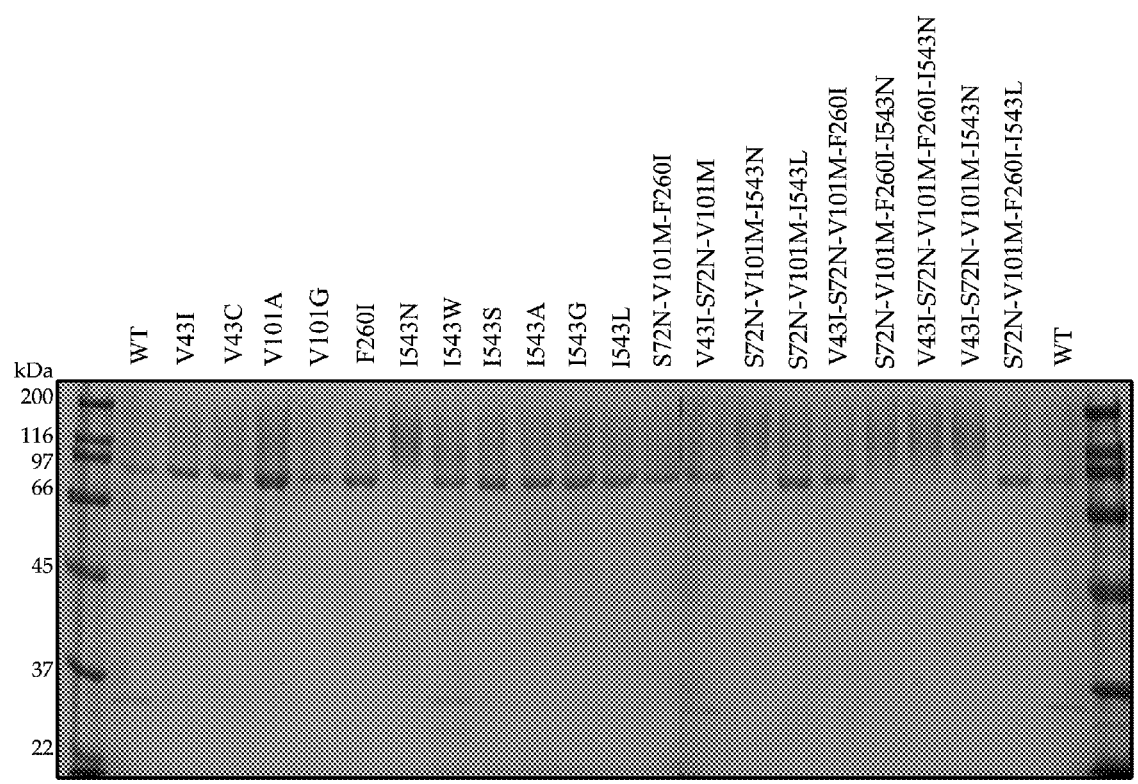
FIG. 4 shows an SDS-PAGE gel of the parental (wt) and modified TrCel3A beta-glucosidases expressed from yeast and purified as described in Example 7, as well as a cellulase enzyme mixture from *Trichoderma reesei* (cellulase) and the wild-type TrCel3A purified from *T. reesei* cellulase (Cel3A). After SDS-PAGE separation, the proteins were visualized by Coomassie Blue stain.

After incubation, the broth from each culture was centrifuged for 10 minutes at 9000 rpm and the pellet (containing yeast cells) discarded. The pH of the supernatant was adjusted to 5.0. The TrCel3A in each spent culture medium was then purified by immobilized metal affinity chromatography (IMAC) using His-Trap NTA/Ni$^{2+}$ columns from GE Healthcare (catalogue #17-5247-01). Purified proteins were concentrated and buffer exchanged using Vivaspin 20 centrifugal concentrators (Sartorius Stedim Biotech, catalogue No. VS2012). Protein concentrations were measured using the method of Bradford (1976) and stored at −20° C. Samples of each purified Modified TrCel3A were separated by SDS-PAGE and visualized by Coomassie Blue stain (FIG. 4).

Example 8

Measuring the K$_G$ and K$_{G2}$ Constants of Parental and Modified TrCel3A Beta-Glucosidases The K$_G$ and K$_{G2}$ constants of each modified TrCel3A beta-glucosidase were determined using a p-nitrophenyl-beta-D-glucopyranoside (pNPG) competitive substrate/inhibitor real-time kinetic assay. Each modified TrCel3A (3 μg/reaction) was incubated with 0.4 mM pNPG in a stirred cuvette; the total reaction volume was 3 mL. Assays were buffered using 50 mM citrate, pH 5.0. Incubations were done at 50° C. for up to 40 min in a Varian Cary UV/Vis spectrophotometer. Absorbance measurements collected at 340 nm during the time course were converted to p-nitrophenol (pNP) concentration using Equation 1.

$$pNP = \frac{Abs_{340nm} - \varepsilon_p NPG \cdot pNPG}{\varepsilon_p NP - \varepsilon_p NPG} \qquad \text{Equation 1}$$

where,
pNP is the concentration of p-nitrophenol (mM),
Abs$_{340nm}$ is the absorbance at 340 nm,
$\varepsilon_{pNPG}$ is the extinction coefficient at 340 nm of pNPG at pH 5.0 (3.33 L cm$^{-1}$±0.04)
pNPG is the initial concentration of pNPG (mM), $\epsilon_{pNP}$ is the extinction coefficient at 340 nm of pNP at pH 5.0 (5.96 L cm$^{-1}$±0.02)

Three different incubations were done for each modified TrCel3A: 1) with pNPG alone, 2) with pNPG and 3 mM cellobiose, and 3) with pNPG and 5 mM glucose. The pNP concentration as a function of time in each of the three reactions was modeled according to Equation 2 using a fourth order Runge-Kutta workbook in MS Excel and using the method of least squares.

$$\frac{dpNP}{dt} = \frac{k_{pNPG} \cdot E \cdot pNPG}{pNPG + K_{pNPG}\left(1 + \frac{G2}{K_{G2}} + \frac{G}{K_G}\right)} \qquad \text{Equation 2}$$

where,
dpNP/dt is the rate of conversion of pNPG to pNP (mM/min),
$k_{pNPG}$ is the catalytic rate constant for the conversion of pNPG to pNP (μmol/min/mg protein),
E is the concentration of TrCel3A (mg/mL),
pNPG is the concentration of p-nitrophenyl-beta-D-glucopyranoside (mM),
$K_{pNPG}$ is the Michaelis constant (or $K_m$) for pNPG (mM),
G2 is the concentration of cellobiose (mM),
$K_{G2}$ is the Michaelis constant (or $K_m$) for cellobiose (mM),
G is the concentration of glucose (mM),
$K_G$ is the glucose inhibition constant (mM).

Figure 5:
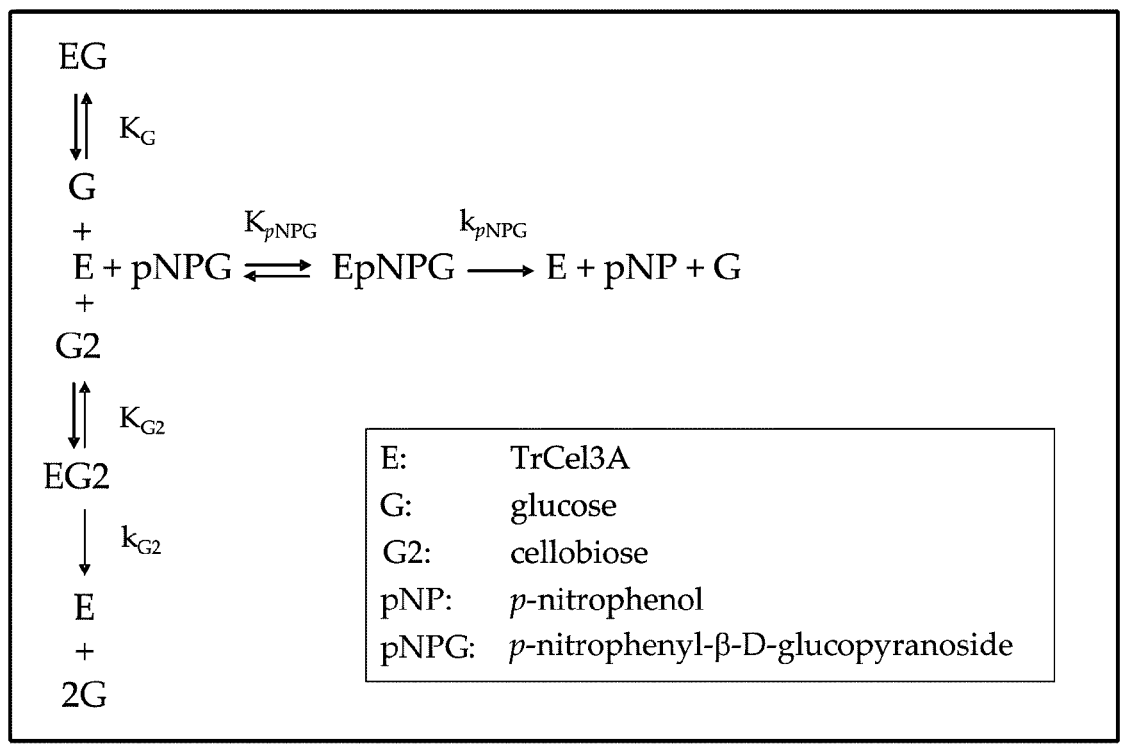
FIG. 5 is a diagram illustrating the reaction scheme of the pNPG competitive substrate/inhibitor kinetic assay.
Figure 6:
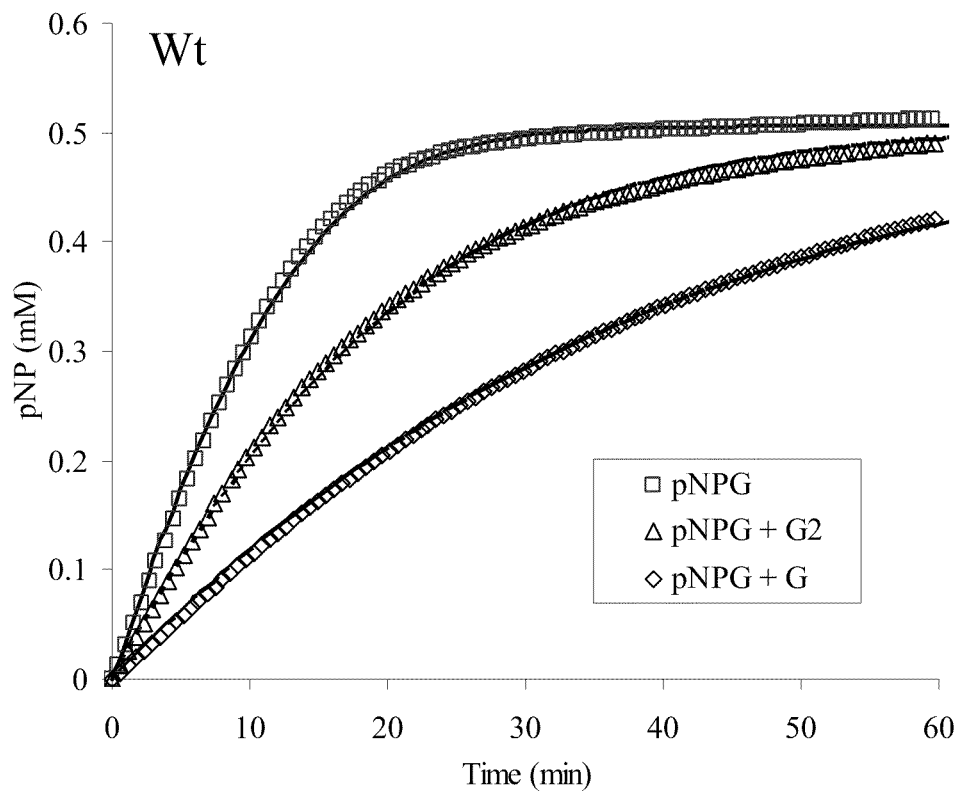
FIG. 6 shows the competitive substrate/inhibitor assay results for parental TrCel3A (Wt).
Figure 7:
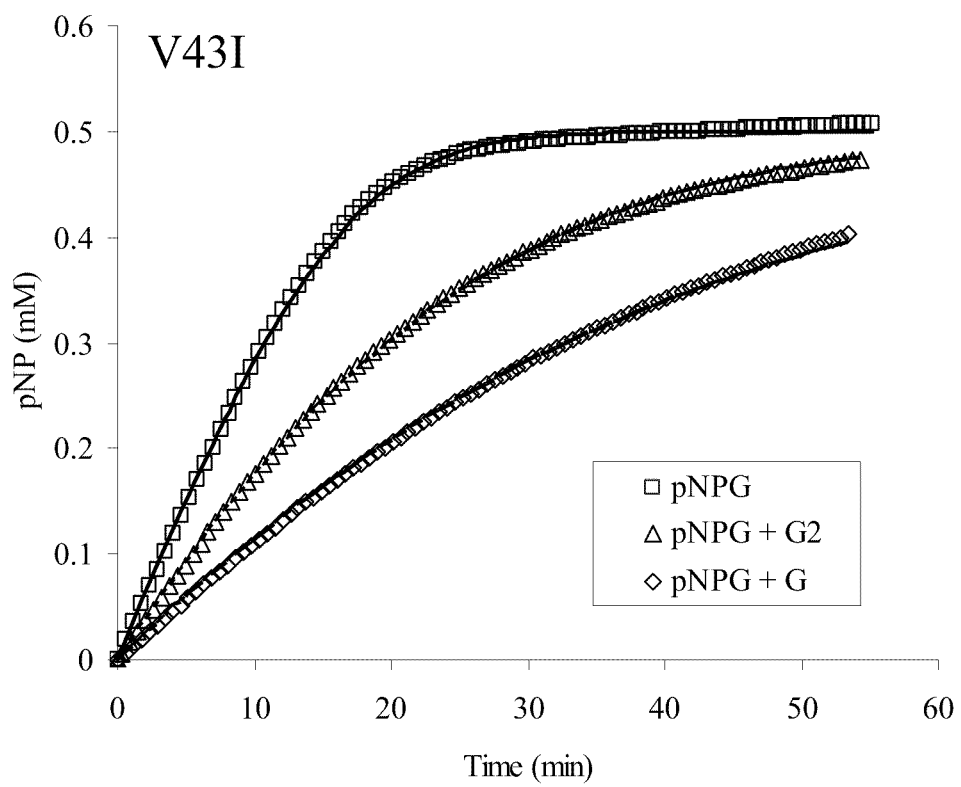
FIG. 7 shows the competitive substrate/inhibitor assay results for the modified TrCel3A-V43I beta-glucosidase.
Figure 8:
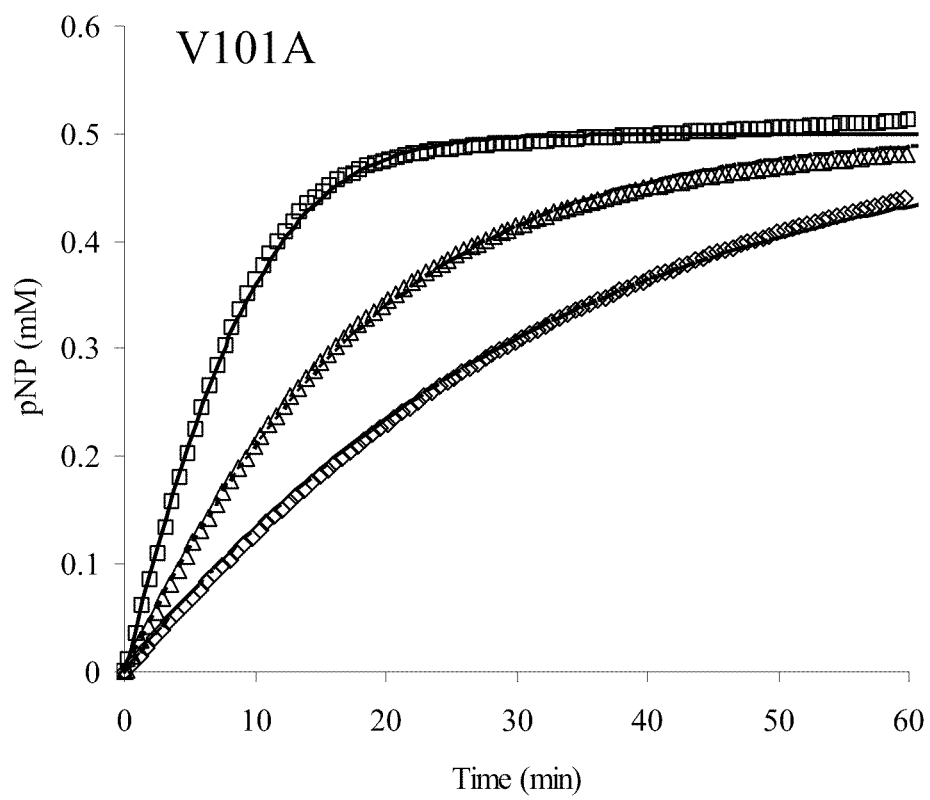
FIG. 8 shows the competitive substrate/inhibitor assay results for the modified TrCel3A-V101A beta-glucosidase.
Figure 9:
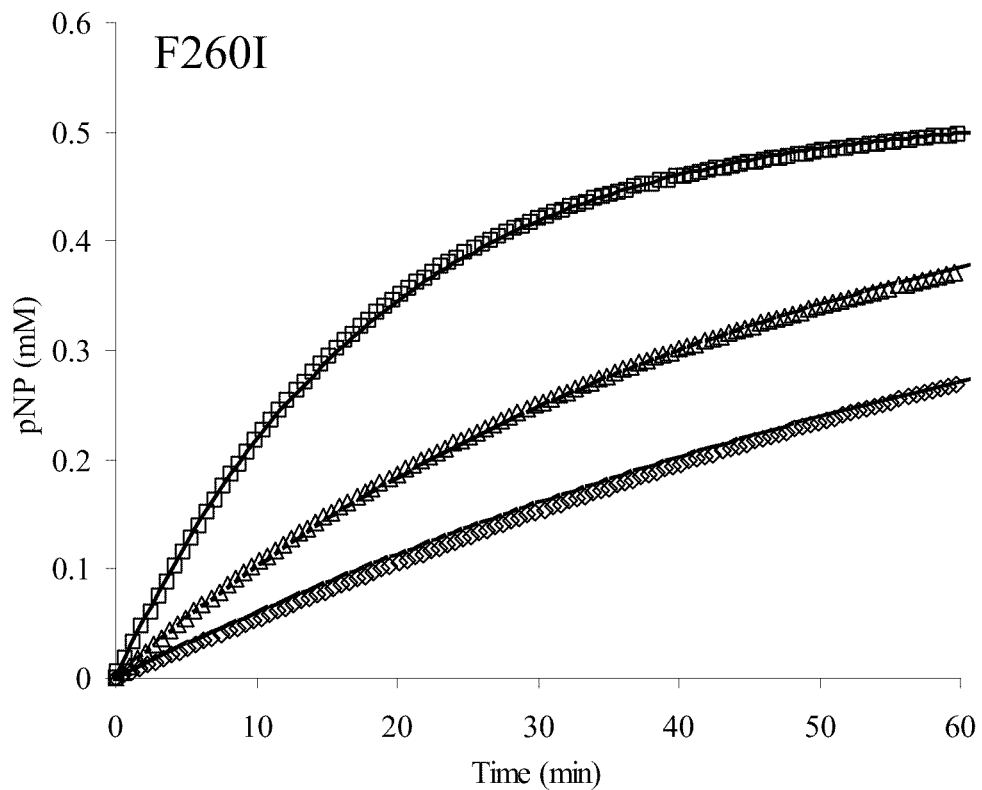
FIG. 9 shows the competitive substrate/inhibitor assay results for the modified TrCel3A-F260I beta-glucosidase.
Figure 10:
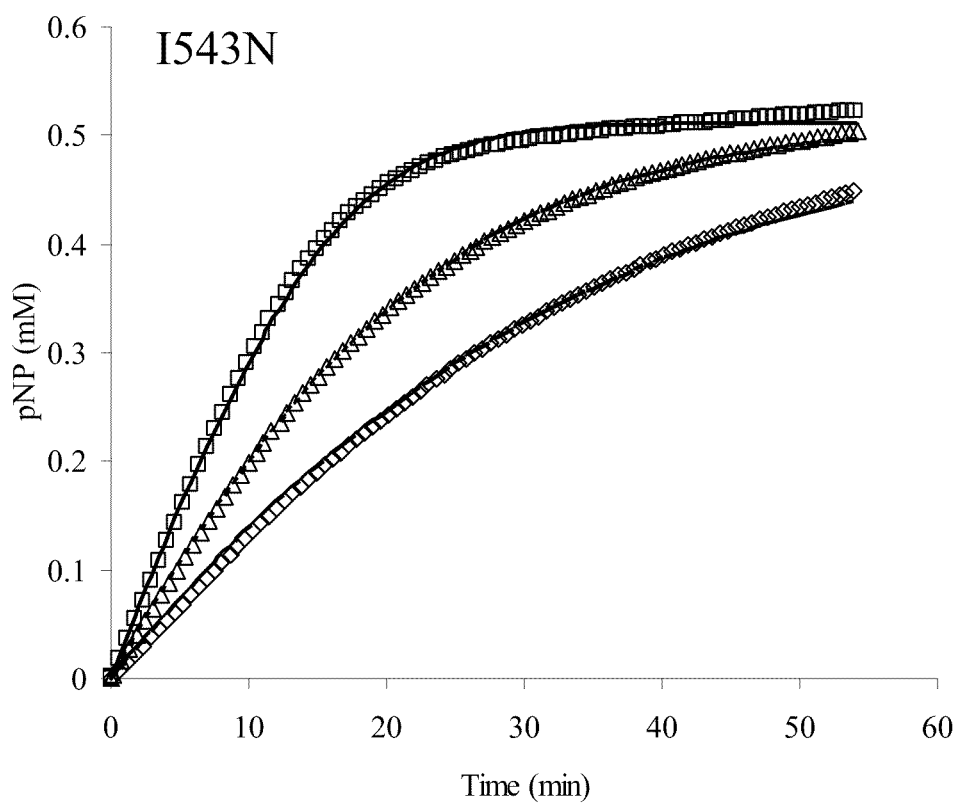
FIG. 10 shows the competitive substrate/inhibitor assay results for the modified TrCel3A-I543N beta-glucosidase.

The reaction scheme for this assay is shown in FIG. 5. In this model, Cel3A hydrolyzes pNPG according to Michaelis-Menten kinetics. Cel3A activity is assumed to be inhibited competitively by glucose as described by the inhibition constant, $K_G$. Therefore, when glucose was added to a cuvette containing pNPG, the rate of pNPG catalysis decreased. The decrease in the rate of pNPG hydrolysis is accounted for by the $K_G$ parameter. Modified TrCel3A beta-glucosidases with a higher $K_G$ value are less affected by glucose, compared to the parental TrCel3A$^{Wt}$, and will have relatively higher rates of pNPG hydrolysis under these conditions. Similarly, when cellobiose was included in the reaction with pNPG, the rate of pNPG hydrolysis decreased. Modified TrCel3A beta-glucosidases with a lower $K_{G2}$ value are more affected by the addition of cellobiose, compared to TrCel3A$^{Wt}$, and will have relatively lower rates of pNPG hydrolysis under these conditions.

The rates of pNPG hydrolysis were assayed for each modified TrCel3A in each of the three conditions, pNPG alone, pNPG+G2 and pNPG+G, by using a global fit of these three data sets to the parameters $k_{pNPG}$, $K_{pNPG}$, $k_{cat}$, $K_{G2}$ and $K_G$ in manner known by one of skill in the art. A $K_G/K_{G2}$ ratio was also calculated using the values of $K_G$ and $K_{G2}$ from each global fit of the three data sets for each modified TrCel3A.

Each modified TrCel3A was assayed in this manner between two and five times. The average $K_G$, $K_{G2}$ and $K_G/K_{G2}$ values determined in this manner and their standard deviations are shown in Table 6. Student's t-test was used to identify modified TrCel3A beta-glucosidases with statistically significant improvements in $K_G$, $K_{G2}$ and $K_G/K_{G2}$ ($P<0.05$) compared to TrCel3A$^{wt}$. Graphs showing representative pNPG hydrolysis data and model fits for TrCel3A-WT (FIG. 6), TrCel3A-V43I (FIG. 7), TrCel3A-V101A (FIG. 8), TrCel3A-F260I (FIG. 9) and TrCel3A-I543N (FIG. 10) are also shown.

The $K_G$ values of TrCel3A-V43C (4.20 mM), TrCel3A-F260I (0.92 mM), TrCel3A-F260D (0.70 mM), TrCel3A-F260Q (0.69 mM), TrCel3A-F260V (0.72 mM) and TrCel3A-I543N (0.94 mM) were higher than that of TrCel3A$^{Wt}$ (0.58 mM). This indicates that the activity of each of these modified TrCel3A beta-glucosidases is significantly less inhibited by glucose and that they maintain relatively higher activity in the presence of glucose than does the parental TrCel3A beta-glucosidase. The values of $K_{G2}$ of several modified TrCel3As with single amino acid substitutions, such as TrCel3A-V43I (0.62 mM) and TrCel3A-V101A (0.82 mM), were significantly (<0.001 and 0.001, respectively) lower than the $K_{G2}$ of wild-type TrCel3A (1.18 mM). Similarly, most of the modified TrCel3As with different combinations of more than one amino acid substitution had lower $K_{G2}$ than wild-type. These modified TrCel3A beta-glucosidases exhibit maximum activity at lower concentrations of cellobiose, indicating that they have a higher affinity for cellobiose. In a cellulose hydrolysis system, such as the conversion of cellulose to fermentable sugars utilizing cellulase such as that from *Trichoderma reesei* or other cellulolytic fungi, the use of a TrCel3A with a lower $K_{G2}$ would contribute to lowering steady-state concentrations of cellobiose and lower product inhibition of cellulase enzymes.

The value of $K_G$, $K_{G2}$, $K_G/K_{G2}$ and $k_{G2}$ for each modified TrCel3A was divided by the value of the corresponding parameter for the parental TrCel3A in order to calculate the relative values shown in Table 2. These results show that the TrCel3A-V43I (1.41), TrCel3A-V101A (1.34), TrCel3A-F260I (1.52) and TrCel3A-I543N (1.35) beta-glucosidases have substantially improved $K_G/K_{G2}$; improvements ranged from 35-52%, relative to TrCel3A$^{Wt}$.

Example 9

Measuring the Catalytic Rate Constant of Parental and Modified TrCel3A Beta-Glucosidases Initial rate assays were used to measure the catalytic rate constant ($k_{cat}$) of the parental and each modified TrCel3A beta-glucosidase on cellobiose. Purified wild-type parental and modified TrCel3A beta-glucosidases were incubated with 12 concentrations of cellobiose, ranging from 0.3 to 40 mM. The protein concentration in each of the reactions was 1 μg/mL. Samples were incubated at 50° C. for 15 min in deep well plates and then placed in a boiling water bath for 10 min to stop the reaction. The concentration of glucose produced at each concentration of substrate was measured as described in Example 7.

The rate of cellobiose consumption for the parental and each modified TrCel3A beta-glucosidase was plotted as a function of cellobiose concentration. As the cellobiose concentration increases from 0.4 mM to 10 mM, the reaction rate of wild-type TrCel3A increases until it reaches an apparent maximum reaction rate (FIG. 12). Further increasing the substrate concentration results in a gradual decrease in the reaction rate, a phenomenon that is reportedly due to substrate inhibition (Cascalheira et al., 1999). As a result, data for the reaction rate as a function of cellobiose concentration were modeled using a modified form of the Michaelis-Menten equation which incorporates a $K_{si}$ term for uncompetitive substrate inhibition (Equation 3).

$$\frac{dG2}{dt} = \frac{\frac{k_{cat} \cdot E \cdot G2}{K_{G2}}}{1 + \frac{G2}{K_{G2}} + \frac{G2^2}{K_{G2} \cdot K_{si}}} \qquad \text{Equation 3}$$

where, dG2/dt is the rate of conversion of cellobiose (G2) to two glucose molecules (2G) (mM G2 consumed/min), $k_{cat}$ is the catalytic rate constant for the conversion of cellobiose to glucose (µmol of G2 consumed/min/mg protein), E is the concentration of TrCel3A (mg/mL), G2 is the concentration of cellobiose (mM), $K_{G2}$ is the Michaelis constant (or Km) for cellobiose (mM), $K_{Si}$ is the cellobiose substrate inhibition constant (mM)

The $k_{cat}$ is the TrCel3A rate constant on cellobiose and $K_{Si}$ is the parameter that describes the substrate inhibition. The data for the parental and each modified TrCel3A beta-glucosidase were fit to this model by non-linear regression using the method of least squares as known to those of skill in the art. The parental and each modified TrCel3A beta-glucosidase were assayed in triplicate on three different occasions. The mean values of $k_{cat}$, $K_{si}$ and their standard deviations are shown in Table 6.

The $k_{cat}$ of several modified TrCel3As, including TrCel3A-F260I (11.06 mmol/min/mg), TrCel3A-I543S (9.76 µmol/min/mg) and TrCel3A-I543L (11.50 µmol/min/mg) was significantly higher than that of wild-type TrCel3A (8.92 µmol/min/mg) (Table 6 and FIG. 12). Therefore, these modified beta-glucosidases catalyze the conversion of cellobiose to two glucose molecules at a faster rate than does wild-type TrCel3A. In a cellulose hydrolysis system, such as the conversion of cellulose to fermentable sugars utilizing cellulase such as that from *Trichoderma reesei*, the use of a TrCel3A with a higher $k_{cat}$ would contribute to lowering steady-state concentrations of cellobiose and lower product inhibition of cellulase enzymes.

TABLE 6

Kinetic Parameters of Parental and Modified TrCel3A beta-glucosidases.
The $K_G$, $K_{G2}$, $K_G/K_{G2}$, $k_{cat}$ and $K_{Si}$ parameters for parental (TrCel3A-Wt) and modified beta-glucosidases were determined as described in Examples 8 and 9. Significant improvements (P value < 0.05) in any of these parameters are shown in bold text.

| TrCel3A- | $K_G$ (mM) | P-value ($K_G$) | $K_{G2}$ (mM) | P-value ($K_{G2}$) | $K_G/K_{G2}$ | P-value ($K_G/K_{G2}$) | $k_{cat}$ (µmol/min/mg) | P-value ($k_{cat}$) | $K_{Si}$ (mM) |
|---|---|---|---|---|---|---|---|---|---|
| V43I | 0.42 ± 0.04 | <0.001 | 0.65 ± 0.07 | <0.001 | 0.66 ± 0.06 | <0.001 | 6.73 ± 0.13 | 0.018 | 64.1 |
| V43C | 4.20 ± 0.57 | <0.001 | 2.39 ± 0.33 | <0.001 | 1.79 ± 0.38 | <0.001 | ND$^a$ | — | ND$^a$ |
| V101A | 0.54 ± 0.18 | 0.593 | 0.82 ± 0.16 | 0.001 | 0.65 ± 0.09 | 0.006 | 7.22 ± 0.18 | 0.049 | 52.5 |
| F260I | 0.92 ± 0.04 | <0.001 | 1.23 ± 0.03 | 0.22 | 0.75 ± 0.02 | <0.001 | 11.06 ± 0.29 | 0.017 | 60.8 |
| F260D | 0.70 | — | 1.31 | — | 0.53 | — | ND$^a$ | — | ND$^a$ |
| F260Q | 0.69 | — | 1.34 | — | 0.51 | — | ND$^a$ | — | ND$^a$ |
| F260V | 0.72 | — | 1.28 | — | 0.56 | — | ND$^a$ | — | ND$^a$ |
| I543N | 0.87 ± 0.12 | 0.001 | 1.39 ± 0.21 | 0.064 | 0.64 ± 0.11 | 0.019 | 6.53 ± 0.17 | 0.006 | 85.5 |
| I543W | 0.56 ± 0.08 | 0.635 | 0.95 ± 0.08 | 0.003 | 0.59 ± 0.06 | 0.041 | 4.53 ± 0.24 | <0.01 | 42.3 |
| I543S | 0.63 | — | 1.08 | — | 0.59 | — | 9.76 ± 0.15 | <0.01 | 102.7 |
| I543A | 0.68 | — | 1.16 | — | 0.59 | — | 8.96 ± 0.19 | 0.944 | 94.5 |
| I543G | 0.54 | — | 1.02 | — | 0.53 | — | 8.02 ± 0.14 | <0.01 | 98.7 |
| I543L | 0.61 | — | 1.13 | — | 0.55 | — | 11.50 ± 0.12 | <0.01 | 129.4 |
| S72N-V101M-F260I | 0.44 ± 0.03 | <0.001 | 0.68 ± 0.04 | <0.001 | 0.65 ± 0.05 | 0.019 | 8.45 ± 0.35 | 0.605 | 38.3 |
| V43I-S72N-V101M | 0.34 ± 0.08 | 0.001 | 0.46 ± 0.04 | <0.001 | 0.73 ± 0.04 | <0.001 | 7.55 ± 0.19 | 0.034 | 38.0 |
| S72N-V101M-I543N | 0.43 ± 0.05 | 0.001 | 0.64 ± 0.04 | <0.001 | 0.66 ± 0.03 | <0.001 | 7.73 ± 0.13 | <0.01 | 40.8 |
| S72N-V101M-I543D | 0.36 ± 0.02 | <0.001 | 0.53 ± 0.04 | <0.001 | 0.68 ± 0.03 | 0.005 | ND | | ND |
| S72N-V101M-I543L | 0.42 ± 0.04 | <0.001 | 0.69 ± 0.06 | <0.001 | 0.61 ± 0.06 | 0.004 | 8.57 ± 0.30 | 0.638 | 35.0 |
| V43I-S72N-V101M-F260I | 0.34 ± 0.09 | 0.009 | 0.36 ± 0.09 | <0.001 | 0.93 ± 0.08 | <0.001 | 6.98 ± 0.25 | 0.029 | 34.6 |
| S72N-V101M-F260I-I543N | 0.64 ± 0.04 | 0.108 | 0.84 ± 0.04 | <0.001 | 0.77 ± 0.08 | 0.004 | 9.12 ± 0.14 | 0.580 | 31.8 |
| V43I-S72N-V101M-F260I-I543N | 0.41 ± 0.02 | <0.001 | 0.38 ± 0.04 | <0.001 | 1.10 ± 0.11 | 0.001 | 6.14 ± 0.04 | <0.001 | 49.3 |
| V43I-S72N-V101M-I543N | 0.30 ± 0.01 | <0.001 | 0.32 ± 0.03 | <0.001 | 0.95 ± 0.09 | 0.001 | 6.51 ± 0.07 | <0.001 | 51.7 |
| S72N-V101M-F260I-I543L | 0.50 ± 0.03 | 0.010 | 0.66 ± 0.06 | <0.001 | 0.77 ± 0.10 | 0.008 | 8.88 ± 0.24 | 0.816 | 53.6 |
| Wt (parental) | 0.58 ± 0.09 | — | 1.18 ± 0.12 | — | 0.49 ± 0.06 | — | 8.92 ± 0.29 | — | 66.1 |

$^a$ND = not determined

Example 10

Expression of Modified Cel3A in *Trichoderma reesei*

10.1: *Trichoderma reesei* Strains

Strain P59G is a genetically modified strain that produces and secretes high levels of the beta-glucosidase encoded by *T. reesei* bgl1 as described in U.S. Pat. No. 6,015,703. The parent strain of P59G and modified Cel3A over-expressing transformant 4115A, is strain BTR213 aux. The strain BTR213 is a derivative of RutC30 (ATCC #56765; Montenecourt and Eveleigh, 1979) produced by random mutagenesis and first selected for ability to produce larger clearing zones on minimal media agar containing 1% acid swollen cellulose and 4 g L$^{-1}$ 2-deoxyglucose and then selected for the ability to grow on lactose media containing 0.2 µg/mL carbendazim. A uridine auxotroph of BTR213, BTR213aux, was obtained through selection of mutants spontaneously resistant to 0.15% w/v 5-fluoroorotic-acid (FOA).

10.2: Generation of *T. reesei* Transformation Vector

Figure 13:
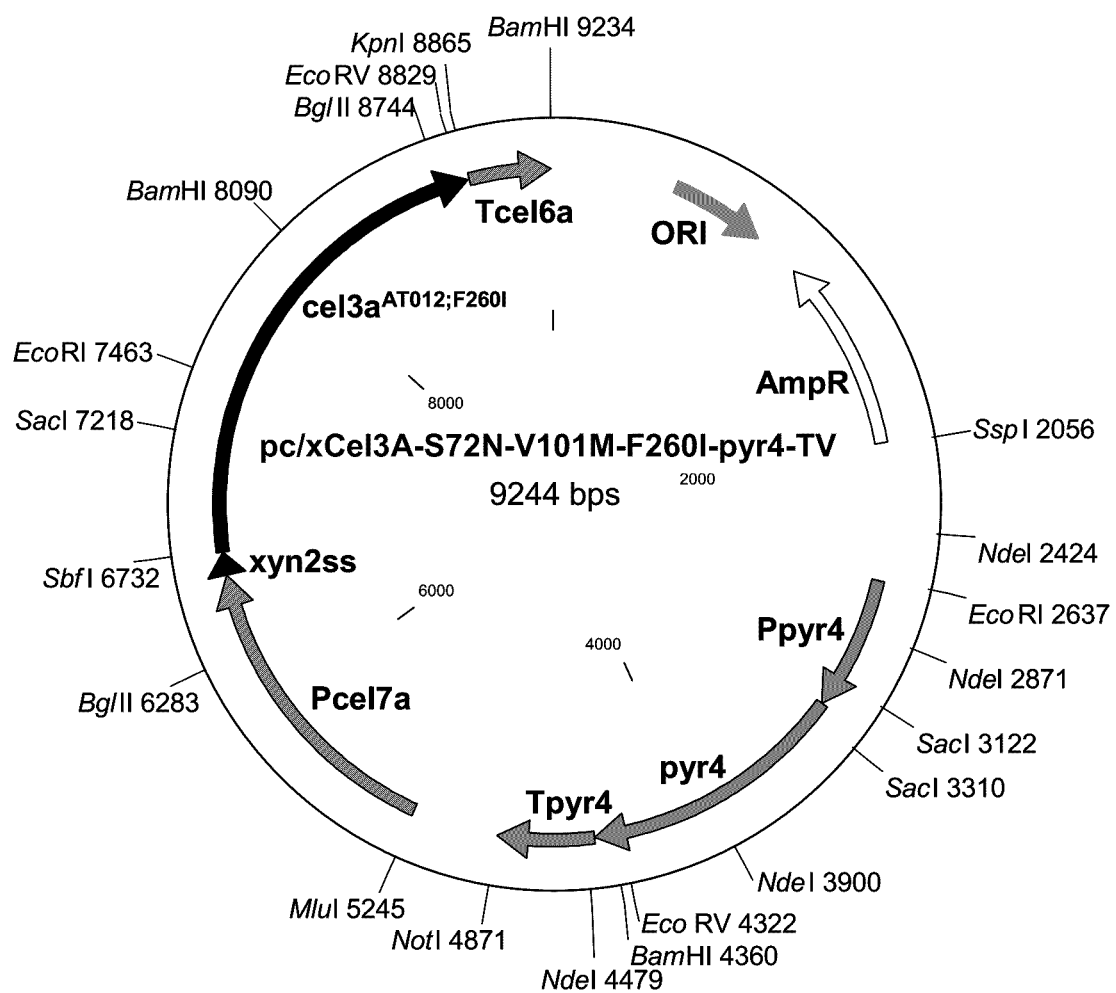
FIG. 13 depicts plasmid vector pc/xCel3A-S72N-V101M-F260I-pyr4-TV directing the expression and secretion of modified TrCel3A beta-glucosidase from genetically modified *Trichoderma reesei*.

The *T. reesei* expression vector was generated using pUC19 vector (Fermentas) as a backbone. To introduce spacers and cloning sites required for cloning of selection and expression cassettes two DNA fragments were amplified using pCAMBIA1301 plasmid (see URL: cambia.org/daisy/cambia/materials/vectors.525.html#dsy585) as a template and two pairs of primers AC166/AC167 and AC168/AC169 (Table 7). The first fragment was cloned into the EcoRI/SacI sites of pUC19 introducing two new PacI/AflII restriction sites. The second fragment was cloned into the SacI/BamHI sites introducing NotI/MluI restriction sites and generating pUC19-GDR vector.

pc/xCel3A-572N-V101M-F260I-Sbf. Next, a 2.2 kb fragment containing the *N. crassa* orotidine-5'-phosphate decarboxylase (pyr4) gene was amplified from pNcBgl (U.S. Pat. No. 6,939,704) containing *N. crassa* pyr4 gene under control of its native promoter and terminator using primers AC323 and AC343 (Table 7). The pyr4 cassette was cloned into pGEM-T-easy, digested with PacI/NotI restriction enzymes, gel purified and cloned into PacI/NotI sites of pc/xCel3A-S72N-V101M-F260I-Sbf generating final transformation vector pc/xCel3A-S72N-V101M-F260I-pyr4-TV (FIG. 13).

TABLE 7

Primers used for construction of *T. reesei* transformation vector pc/xCel3A-AT012; F260I-pyr4-TV.

| Primer name | Primer sequence |
| --- | --- |
| AC166 | ACTGAATTCTTAATTAAGAACCGACGACTCGTCCGTC (SEQ ID NO: 57) |
| AC167 | GTGGAGCTCCTTAAGGTGACATCGGCTTCAAATGGC (SEQ ID NO: 58) |
| AC168 | GCAGAGCTCGCGGCCGCGAACCGACGACTCGTCCGTC (SEQ ID NO: 59) |
| AC169 | CTGGGATCCGATATCACGCGTGTGACATCGGCTTCAAATGGC (SEQ ID NO: 60) |
| AC230 | TTTACGCGTGATTATGGCGTACTAGAGAGCGG (SEQ ID NO: 61) |
| AC231 | CTGCAGGAGGTACAACCTGGCGCTTCTCCACAGCCACGG (SEQ ID NO: 62) |
| AC232 | GTGGAGAAGCGCCAGGTTGTACCTCCTGCAGGGACTCCATG (SEQ ID NO: 63) |
| AC233 | TTTGGTACCCTACGCTACCGACAGAGTGCTCG (SEQ ID NO: 64) |
| AC323 | TTTGCGGCCGCCATCATTCGTCGCTTTCGG (SEQ ID NO: 65) |
| AC343 | TTCGATCGACTATACCACCACCCACCG (SEQ ID NO: 66) |
| Tcel6A-F | CTGGGTACCGGCTTTCGTGACCGGGCTTC (SEQ ID NO: 67) |
| Tcel6A-R | CTGGGATCCGATGGACTAGTACAGCCATG (SEQ ID NO: 68) |

For the construction of the TrCel3A expression cassette, a fragment containing the TrCel7A promoter and xylanase 2 secretion signal (Pcel7a-Xyn2ss fragment) was amplified using primers AC230/AC231 (Table 7) and pC/XBG-TV vector (U.S. Pat. No. 6,015,703) as template. The gene encoding TrCel3A-S72N-V101M-F260I (described in Example 6) was amplified using primers AC232 and AC233 (Table 7). The Pcel7a-Xyn2ss fragment was ligated to the TrCel3A-572N-V101M-F260I encoding gene in two subsequent PCR reactions using primers AC230 and AC233 (Table 7) to produce the resulting c/xCel3A-572N-V101M-F260I fragment. A fragment comprising the cel6a terminator (Tcel6a fragment) was amplified from the pC/XBG-TV (U.S. Pat. No. 6,015,703) template using primers Tcel6a-F and Tcel6a-R (Table 7), which introduced BamHI/KpnI restriction sites, respectively. The c/xCel3A-572N-V101M-F260I and Tcel6a fragments were cloned into pGEM-Teasy vectors generating vectors pGEM-c/xCel3A-572N-V101M-F260I and pGEM-Tcel6a which were then digested with MluI/KpnI and BamHI/KpnI restriction enzymes to release the c/xCel3A-572N-V101M-F260I and Tcel6a fragments, respectively. Both fragments were gel isolated and cloned by three fragment ligation into MluI/BamHI sites of the pUC-GDR vector, generating pc/xCel3A-572N-V101M-F260I. To eliminate the SbfI restriction site, pc/xCel3A-572N-V101M-F260I was digested with XbaI/SphI and the ends modified by removal of the 5' overhang and filling in of the 3' overhang. The linear plasmid was then ligated back together generating 10.3: *Trichoderma reesei* Transformation and Characterization of Transformants

*Trichoderma* strain 4115A was generated by transformation of pc/xCel3A-S72N-V101M-F260I-pyr4-TV into strain BTR213aux by biolistic gold particle bombardment using the PDS-1000/He system (BioRad; E.I. DuPont de Nemours and Company). Gold particles (median diameter of 0.6 um, Bio-Rad Cat. No. 1652262) were used as microcarriers. The following parameters were used in the optimization of the transformation: a rupture pressure of 1100 psi, a helium pressure of 29 mm Hg, a gap distance of 6 mm and a target distance of 6 cm. The spore suspension was prepared by washing *T. reesei* spores from PDA plates incubated for 4-5 days at 30° C. with sterile water. About $5 \times 10^7$ spores were plated on 60 mm diameter plates containing minimal media agar (MM). After particle delivery, all transformation plates were incubated at 30° C. for 5-10 days. All transformants were transferred to minimal media agar and incubated at 30° C.

| Minimal medium (MM*) agar: | |
| --- | --- |
| Component | Amount for 1 L of medium |
| $KH_2PO_4$ | 10 g |
| $(NH_4)_2SO_4$ | 6 g |
| $Na_3Citrate \cdot 2H_2O$ | 3 g |
| $FeSO_4 \cdot 7H_2O$ | 5 mg |

-continued

| Minimal medium (MM*) agar: | |
|---|---|
| Component | Amount for 1 L of medium |
| MnSO$_4$•H$_2$O | 1.6 mg |
| ZnSO$_4$•7H$_2$O | 1.4 mg |
| CaCl$_2$•2H$_2$O | 2 mg |
| Agar | 20 g |
| 20% Glucose f.s. | 50 ml |
| 1 M MgSO$_4$•7H$_2$O f.s. | 4 mL |
| | pH to 5.5 |

*MMSS agar contains the same components as MM agar plus 1.2 M sorbitol, 4 mM MgSO$_4$, 1 g/L YNB (Yeast Nitrogen Base w/o Amino Acids from DIFCO Cat. No. 291940) and 0.12 g/L amino acids (-Ura DO Supplement from CLONTECH Cat. No. 8601-1).

All *T. reesei* transformants were pre-screened for production of active modified TrCel3A beta-glucosidase using Esculin (β-D-glucose-6,7-dihydroxycoumarin) plate assay. An esculin stock solution was made by mixing 2 g of Esculin and 0.6 g FeCl$_3$ in 200 mL of deionized water. The mixture was heated until dissolved, cooled to approximately 40° C. and filter sterilized. Transformants were plated on minimal media agar plates containing 1% cellobiose and grown for 3 to 4 days at 30° C. The esculin stock solution was diluted four-fold with 250 mM citrate buffer, pH 4.8 and 15 mL of the diluted esculin solution were overlaid onto the plates. Plates were incubated at 30° C. for one hour. Positive transformants were selected according to formation of black precipitate formed around *T. reesei* colonies.

Individual *Trichoderma* colonies selected for the expression of active modified TrCel3A beta-glucosidases were transferred to potato dextrose agar (PDA) (Difco) plates and allowed to sporulate. At that time, about $10^4$-$10^6$ spores of each individual transformant, parental and P59G strains were used to inoculate 1 mL of microculture medium in 24-well micro-plates.

| Microculture medium | |
|---|---|
| Component | g/L |
| (NH$_4$)$_2$SO$_4$ | 12.7 |
| KH$_2$PO$_4$ | 8.0 |
| MgSO$_4$•7H$_2$O | 4.0 |
| CaCl$_2$•2H$_2$O | 1.02 |
| CSL | 5.0 |
| CaCO$_3$ | 20.0 |
| Carbon source** | 30-35 |
| Trace elements* | 2 mL/L |
| | pH 5.5 |

*Trace elements solution contains 5 g/L FeSO$_4$•7H$_2$0; 1.6 g/L MnSO$_4$•H$_2$0; 1.4 g/Ll ZnSO$_4$•7H$_2$0.
**glucose, Solka floc, lactose, cellobiose, sophorose, corn syrup, or Avicel. The carbon source can be sterilized separately as an aqueous solution at pH 2 to 7 and added to the remaining media initially or through the course of the fermentation.

The cultures were incubated at a temperature of 30° C. with shaking at 250 rpm for 6 days. The biomass was separated from growth media containing the secreted protein by centrifugation at 12000 rpm. The protein concentration was determined using the Bio-Rad Protein Assay (Cat. No. 500-0001).

Figure 14:
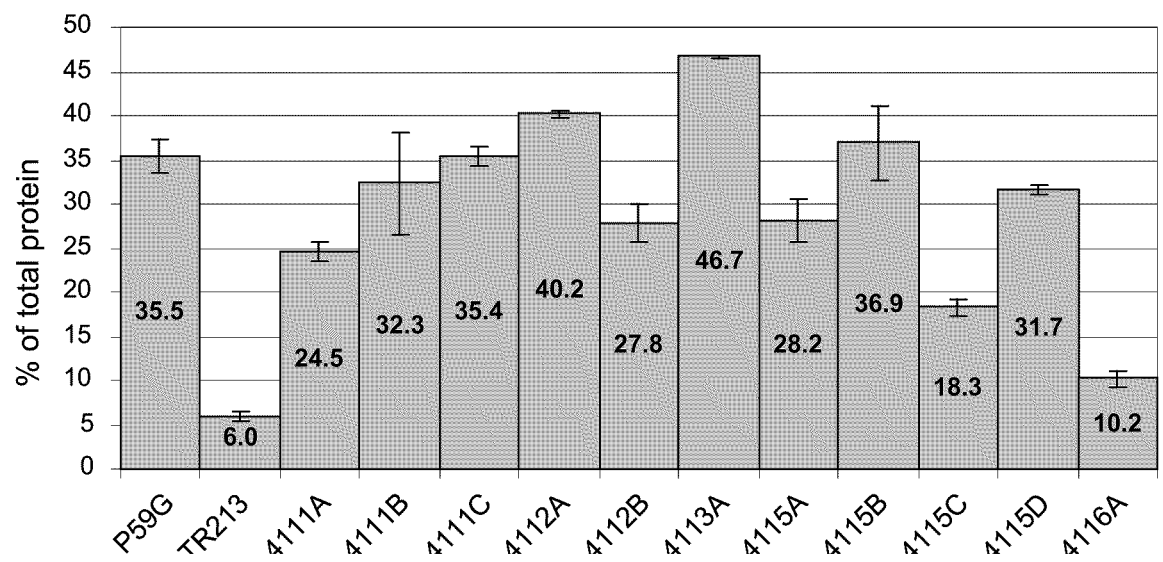
FIG. 14 shows the relative abundance of modified TrCel3A beta-glucosidases in cellulase mixtures produced by genetically modified *Trichoderma reesei*.

The concentration of Cel3A in supernatants from *Trichoderma reesei* microcultures was determined by ELISA (FIG. 14). Filtrate and purified component standard were diluted 0.01-10 μg/mL (based on total protein) in phosphate-buffered saline, pH 7.2 (PBS) and incubated overnight at 4° C. in microtitre plates (Costar EIA #9018). These plates were washed with PBS containing 0.1% Tween-20 (PBS/Tween) and then incubated in PBS containing 1% bovine serum albumin (PBS/BSA) for 1 hr at room temperature. Blocked microtitre wells were washed with PBS/Tween. Rabbit polyclonal antisera specific for TrCel3A was diluted (1:8,000) in PBS/BSA, added to separate microtitre plates and incubated for 2 h at room temperature. Plates were washed and incubated with a goat anti-rabbit antibody coupled to horseradish peroxidase (Sigma #A6154), diluted 1/2000 in PBS/BSA, for 1 h at room temperature. After washing, tetramethylbenzidine was added to each plate and incubated for 30 min at room temperature. The absorbance at 360 nm was measured in each well and converted into protein concentration using a TrCel3A standard curve.

10.4: *Trichoderma reesei* Pilot Fermentation

For 14 L pilot fermentations, *T. reesei* strains were grown on Potato Dextrose Agar at 28-30° C. until a confluent lawn of spores was obtained. Spores were collected and used to inoculate 750 ml of Berkeley media (10 g/L glucose, 1.4 g/L (NH$_4$)$_2$SO$_4$, 2.0 g/L KH$_2$PO$_4$, 0.31 g/L MgSO$_4$.7H$_2$O, 0.53 g/L CaCl$_2$, 5.1 g/L dry corn steep, 5 mg/L FeSO$_4$.7H$_2$O, 0.8 mg/L MnSO$_4$.H$_2$O, 0.7 mg/L ZnSO$_4$.7H$_2$O) in a 2 L baffled flask. After 3 days of growth at 28° C. and 150 rpm, this culture was used to inoculate 10 L of fermentation medium with the following initial composition: 13 g/l glucose, 2.2 g/l (NH$_4$)$_2$SO$_4$, 1.39 g/l KH$_2$PO$_4$, 0.7 g/l MgSO$_4$.7H$_2$O, 0.185 g/l CaCl$_2$, 6 g/l dry corn steep, 1.75 mg/l FeSO$_4$.7H$_2$O, 0.56 mg/l MnSO$_4$.H$_2$O, 0.49 g/l ZnSO$_4$.7H$_2$O. A fed-batch aerobic fermentation using an inducing carbohydrate source was run for 6 days at pH 5 and 28° C. in a 14 L New Brunswick Microferm fermentor. After 6 days, the culture was filtered over Harborlite 1500S and the culture filtrate saved.

The concentration of parental or modified TrCel3A beta-glucosidases in fermentation filtrate from *Trichoderma reesei* was determined by ELISA as described above (Example 10.3).

Example 11

Measuring the Cellulose Hydrolysis Activity of a Whole Cellulase Secreted by a Strain of *Trichoderma* that Expresses High Levels of a Modified Beta-Glucosidase A whole enzyme produced by a strain of *Trichoderma* that expresses high concentrations of a modified beta-glucosidase, TrCel3A-S72N-V101M-F260I, was compared to that from a strain that expresses similar concentrations of the parental, wild-type TrCel3A in an extended hydrolysis time course assay on a lignocellulosic substrate. The concentrations of the wild-type and the modified beta-glucosidase in their respective whole cellulase mixtures were 31.1±1.7% and 28.2±1.3% of total protein, respectively. Whole *Trichoderma* cellulase mixtures containing these TrCel3A beta-glucosidases were incubated with pretreated wheat straw at a concentration of 25 g/L cellulose at a dose of 10 mg of total cellulase mixture per gram of cellulose. Triplicate assays were performed for each cellulase mixture under the same conditions. The hydrolysis assays were buffered in 50 mM citrate, pH 5.0 containing 0.1% sodium benzoate. The assay was conducted at 50° C. for 96 hr with continuous orbital shaking. Aliquots of 0.7 mL were taken at various time points from each flask and the glucose concentration in the soluble portion was assayed and converted into a measure of fractional cellulose conversion. The conversion data were then fit with a rectangular hyperbola with an additional linear term using minimization of the sum of squared residuals of fit. The equation was of the following form: conversion=(max*time)/

(halfmax+time)+c*time. Both sets of data were fit globally with unique max and halfmax values and a shared value of the variable c.

Figure 15:
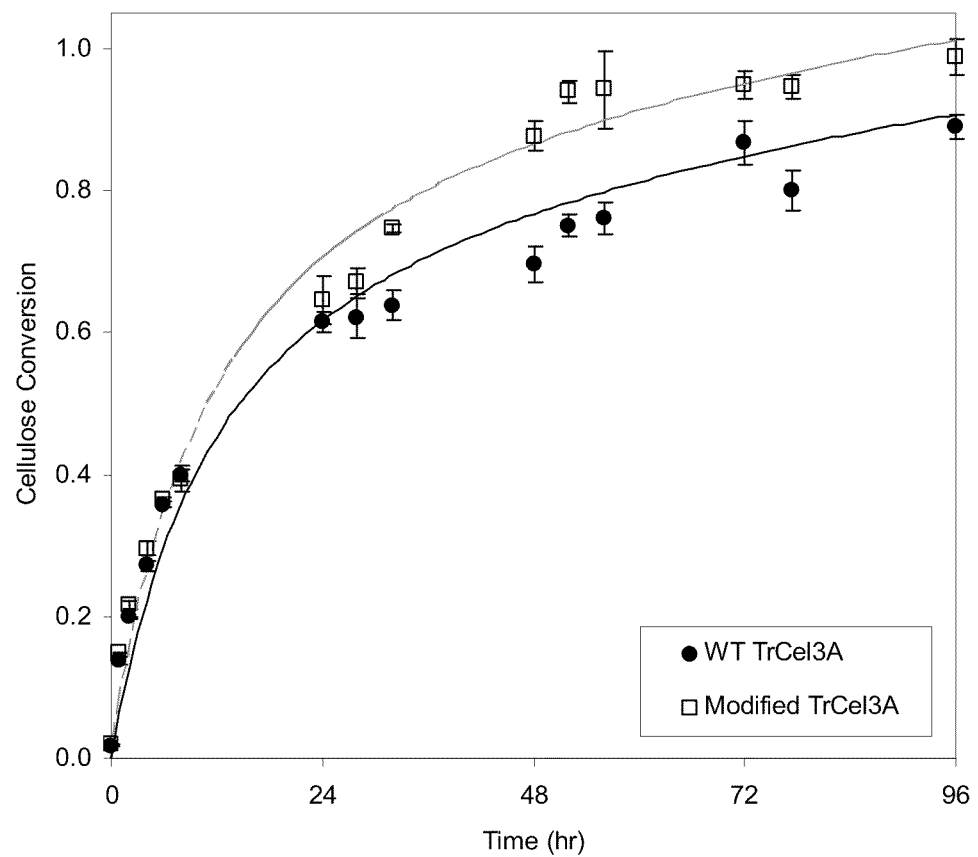
FIG. 15 is a plot showing the conversion of cellulose in a pretreated lignocellulosic substrate by cellulase mixtures comprising parental (WT TrCel3A) or modified (Modified TrCel3A) beta-glucosidases produced by genetically modified *Trichoderma reesei*.

The results are shown in FIG. 15. This figure demonstrates that the fractional cellulose conversion measured for the cellulase mixture containing the modified TrCel3A beta-glucosidase was higher at 96 hr (0.99±0.03) than for the cellulase mixture containing the wild-type TrCel3A beta-glucosidase (0.89±0.02). This increase in fractional cellulose conversion was statistically significant (P<0.05, Student's T-Test).

REFERENCES

Berghem, L. E. and Pettersson, L. G. (1974) The mechanism of enzymatic cellulose degradation. Isolation and some properties of a beta-glucosidase from *Trichoderma viride*. *European Journal of Biochemistry*, 46(2):295-305.

Bhatia, Y., Mishra, S, and Bisaria, V. S. (2002) Microbial beta-Glucosidases: Cloning, Properties and Applications. *Critical Reviews in Biotechnology*, 22(4):375-407)

Bradford, M. M. (1976) A rapid and sensitive method for quantitation of microgram quantities of protein utilizing the principle of protein-dye binding. *Analytical Biochemistry*, 72:248-254.

Butler, T. and Alcalde, M. (2003) In Methods in Molecular Biology, vol. 231: (F. H. Arnold and G. Georgiou, editors), Humana Press Inc. Totowa (N.J.), pages 17-22.

Cascalheira, J. F., Queiroz, J. A. (1999) Kinetic study of the cellobiase activity of *Trichoderma reesei* cellulase complex at high substrate concentrations. *Biotechnology Letters*, 21(8):651-655

Chen, H., Li, X. and Ljungdahl, L. G. (1994) Isolation and properties of an extracellular beta-glucosidase from the polycentric rumen fungus *Orpinomyces* sp. strain PC-2. *Applied and Environmental Microbiology*, 60(1):64-70.

Chirico, W. J. and Brown, R. D. Jr. (1987) Purification and characterization of a beta-glucosidase from *Trichoderma reesei*. *European Journal of Biochemistry*, 165(2):333-341.

Christakopoulos, P., Goodenough, P. W., Kekos, D., Macris, B. J., Claeyssens, M. and Bhat, M. K. (1994) Purification and characterization of an extracellular beta-glucosidase with transglycosylation and exo-glucosidase activities from *Fusarium oxysporum*. *European Journal of Biochemistry*, 224(2):279-385.

Eijsink V G, Gaseidnes C., Borchert T V, van den Burg B. 2005. Directed Evolution of Enzyme Stability. *Biomol. Eng.* 22:21-30

Enari, T.-M., Niku-Paavola, M.-L., Harju, L., Lappalainen, A. and Nummi, M. (1981) Purification of *Trichoderma reesei* and *Aspergillus niger* beta-glucosidase. *Journal of Applied Biochemistry*, 3:157-163.

Foreman, P. K., Brown, D., Dankmeyer, L., Dean, R., Diener, S., Dunn-Coleman, N. S., Goedegebuur, F., Houfek, T. D., England, G. J., Kelley, A. S., Meerman, H. J., Mitchell, T., Mitchinson, C., Olivares, H. A., Teunissen, P. J., Yao, H. and Ward, M. (2003) Transcriptional regulation of biomass-degrading enzymes in the filamentous fungus *Trichoderma reesei*. *Journal of Biological Chemistry*, 278(34): 31988-31997.

Gietz, R. D. and Woods, R. A. (2002) Transformation of yeast by the Liac/ss carrier DNA/PEG method. In *Methods in Enzymology*, 350:87-96.

Gueguen, Y., Chemardin, P., Arnaud, A. and Galzy, P. (1995) Purification and characterization of an intracellular beta-glucosidase from *Botrytis cinerea*. *Enzyme and Microbial Technology*, 78:900-906.

Henrissat, B. (1991) A classification of glycosyl-dydrolases based on amino acid sequence similarities. *Biochemical Journal*, 293:781-788;

Henrissat, B. (1994) Cellulases and their interaction with cellulose. *Cellulose*, 1:169-196.

Henrissat, B. and Bairoch, A. (1996) Updating the sequence-based classification of glycosyl hydrolases. *Biochemical Journal*, 316:695-696

Holtzapple, M., Cognata, M., Shu, Y., and Hendrickson, C. (1990) Inhibition of *Trichoderma reesei* cellulase by sugars and solvents. *Biotechnology and Bioengineering*, 36:275.

Knowles, J., Lehtovaara, P. and Teeri, T. Cellulase families and their genes. (1987) *Trends in Biotechnology*, 5:255-261.

Li, X. L. and Calza, R. E. (1991) Purification and characterization of an extracellular beta-glucosidase from the Rumen Fungus *Neocallimastix frontalis* EB188. *Enzyme and Microbial Technology*, 13:622-628.

Lynd, L. R., Weimer, P. J., van Zyl, W. H. and Pretorius I. S. (2002) Microbial cellulose utilization: fundamentals and biotechnology. *Microbiology and Molecular Biology Reviews*, 66:506-577.

Perez-Pons, J. A., Cayetano, A., Rebordosa, X., Lloberas, J., Guasch, A. and Querol, E. (1994) A beta-glucosidase gene (bg13) from *Streptomyces* sp. strain QM-B814. Molecular cloning, nucleotide sequence, purification and characterization of the encoded enzyme, a new member of family 1 glycosyl hydrolases. *European Journal of Biochemistry*, 223(2):557-565.

Riou, C., Salmon, J. M., Vallier, M. J., Güinata, Z. and Barre, P. (1998) Purification, characterization and substrate specificity of a novel highly glucose-tolerant beta-glucosidase from *Aspergillus oryzae*. *Applied and Environmental Microbiology*, 64(10):3607-3614.

Saha, B. C. and Bothast, R. J. (1996) Production, purification and characterization of a highly glucose-tolerant novel beta-glucosidase from *Candida peltata*. *Applied and Environmental Microbiology*, 62(9):3165-3170.

Teeri, T. T. (1997) Crystalline cellulose degradation: new insight into the function of cellobiohydrolases. *Trends in Biotechnology*, 15(5):160-167.

Teleman, A., Koivula, A., Reinikainen, T., Valkeajarvi, A., Teeri, T. T., Drakenberg, T., and Teleman, O. (1995) Progress-curve analysis shows that glucose inhibits the cellotriose hydrolysis catalysed by cellobiohydrolase II from *Trichoderma reesei*. *European Journal of Biochemistry*, 231:250.

Trinder, P. (1969) Determination of glucose in blood using glucose oxidase with an alternative oxygen accepter. *Annals of Clinical Biochemistry*, 6:24-27.

Varghese, J. N., Hrmova, M., Fincher, G. B. (1999) Three-dimensional structure of a barley beta-D-glucan exohydrolase, a family 3 glycosyl hydrolase. *Structure Fold. Des.* 7: 179-190

Wood, T. M. and Garcia-Campayo, V. (1990) Enzymology of cellulose degradation. *Biodegradation*, 1:147-161.

Zhang, Y. H. and Lynd, L. R. (2004) Toward an aggregated understanding of enzymatic hydrolysis of cellulose. *Biotechnology and Bioengineering*, 88(7):797-824.

SEQUENCE LISTING (182 sequences)

SEQ ID NO: 1 - protein, 582 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKF

SEQ ID NO: 2 - protein, 582 aa, Trichoderma reesei
VVPPAGTPWGTAYDKAKAALAKLNLQDKVGIVSGVGWNGGPCIGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKF

SEQ ID NO: 3 - protein, 582 aa, Trichoderma reesei
VVPPAGTPWGTAYDKAKAALAKLNLQDKVGIVSGVGWNGGPCCGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKF

SEQ ID NO: 4 - protein, 582 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEAKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKF

SEQ ID NO: 5 - protein, 582 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEGKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKF

SEQ ID NO: 6 - protein, 582 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDINGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKF

SEQ ID NO: 7 - protein, 582 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDVNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKF

SEQ ID NO: 8 - protein, 582 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDQNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKF

SEQ ID NO: 9 - protein, 582 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDDNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKF

SEQ ID NO: 10 - protein, 582 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRNVSGGSDSFSEGLFIDYKHFDDANITPRYEFGYGLSYTKF

SEQ ID NO: 11 - protein, 582 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRWVSGGSDSFSEGLFIDYKHFDDANITPRYEFGYGLSYTKF

SEQ ID NO: 12 - protein, 582 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRAVSGGSDSFSEGLFIDYKHFDDANITPRYEFGYGLSYTKF

SEQ ID NO: 13 - protein, 582 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRSVSGGSDSFSEGLFIDYKHFDDANITPRYEFGYGLSYTKF

SEQ ID NO: 14 - protein, 582 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRGVSGGSDSFSEGLFIDYKHFDDANITPRYEFGYGLSYTKF

SEQ ID NO: 15 - protein, 582 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRLVSGGSDSFSEGLFIDYKHFDDANITPRYEFGYGLSYTKF

SEQ ID NO: 16 - protein, 582 aa, Trichoderma reesei
VVPPAGTPWGTAYDKAKAALAKLNLQDKVGIVSGVGWNGGPCVGNTSPASKISYPSLCLQDGPLGVRYSTGNTAFTPGVQAASTWDVNLIRERGQFIGEEMKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDINGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKF

SEQ ID NO: 17 - protein, 582 aa, Trichoderma reesei
VVPPAGTPWGTAYDKAKAALAKLNLQDKVGIVSGVGWNGGPCIGNTSPASKISYPSLCLQDGPLGVRYSTGNTAFTPGVQAASTWDVNLIRERGQFIGEEMKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKF

SEQ ID NO: 18 - protein, 582 aa, Trichoderma reesei
VVPPAGTPWGTAYDKAKAALAKLNLQDKVGIVSGVGWNGGPCVGNTSPASKISYPSLCLQDGPLGVRYSTGNTAFTPGVQAASTWDVNLIRERGQFIGEEMKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRNVSGGSDSFSEGLFIDYKHFDDANITPRYEFGYGLSYTKF

SEQ ID NO: 19 - protein, 582 aa, Trichoderma reesei
VVPPAGTPWGTAYDKAKAALAKLNLQDKVGIVSGVGWNGGPCVGNTSPASKISYPSLCLQDGPLGVRYSTGNTAFTPGVQAASTWDVNLIRERGQFIGEEMKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRDVSGGSDSFSEGLFIDYKHFDDANITPRYEFGYGLSYTKF

SEQ ID NO: 20 - protein, 582 aa, Trichoderma reesei
VVPPAGTPWGTAYDKAKAALAKLNLQDKVGIVSGVGWNGGPCVGNTSPASKISYPSLCLQDGPLGVRYSTGNTAFTPGVQAASTWDVNLIRERGQFIGEEMKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRLVSGGSDSFSEGLFIDYKHFDDANITPRYEFGYGLSYTKF

SEQ ID NO: 21 - protein, 582 aa, Trichoderma reesei
VVPPAGTPWGTAYDKAKAALAKLNLQDKVGIVSGVGWNGGPCIGNTSPASKISYPSLCLQDGPLGVRYSTGNTAFTPGVQAASTWDVNLIRERGQFIGEEMKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDINGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKF

SEQ ID NO: 22 - protein, 582 aa, Trichoderma reesei
VVPPAGTPWGTAYDKAKAALAKLNLQDKVGIVSGVGWNGGPCIGNTSPASKISYPSLCLQDGPLGVRYSTGNTAFTPGVQAASTWDVNLIRERGQFIGEEMKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDINGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRNVSGGSDSFSEGLFIDYKHFDDANITPRYEFGYGLSYTKF

SEQ ID NO: 23 - protein, 582 aa, Trichoderma reesei
VVPPAGTPWGTAYDKAKAALAKLNLQDKVGIVSGVGWNGGPCIGNTSPASKISYPSLCLQDGPLGVRYSTGNTAFTPGVQAASTWDVNLIRERGQFIGEEMKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRNVSGGSDSFSEGLFIDYKHFDDANITPRYEFGYGLSYTKF

SEQ ID NO: 24 - DNA, 26 bp, Artificial
  Primer sequence
cgccaggctagcgttgtacctcctgc

SEQ ID NO: 25 - DNA, 25 bp, Artificial
  Primer sequence
ctgagggtaccgctacgctaccgac

SEQ ID NO: 26 - DNA, 26 bp, Artificial
  Primer sequence
cccgctagtattgccgtcgttggatc

SEQ ID NO: 27 - DNA, 27 bp, Artificial
  Primer sequence
ccaacgacggcaatactagcgggcttc

SEQ ID NO: 28 - DNA, 37 bp, Artificial
  Primer sequence
gttcggctatggactgtcttacaccaagttcaactac

SEQ ID NO: 29 - DNA, 36 bp, Artificial
  Primer sequence
gttgaacttggtgtaagacagtccatagccgaactc

SEQ ID NO: 30 - DNA, 22 bp, Artificial
  Primer sequence
ctagctgatcactgaggtaccg

SEQ ID NO: 31 - DNA, 22 bp, Artificial
  Primer sequence
aattcggtacctcagtgatcag

SEQ ID NO: 32 - DNA, 46 bp, Artificial
  Primer sequence
ctagtcatcaccatcaccatcacgctagctgatcactgaggtaccg

SEQ ID NO: 33 - DNA, 46 bp, Artificial
  Primer sequence
aattcggtacctcagtgatcagctagcgtgatggtgatggtgatga

SEQ ID NO: 34 - DNA, 21 bp, Artificial
  Primer sequence
agcacaaataacgggttattg

SEQ ID NO: 35 - DNA, 23 bp, Artificial
  Primer sequence
gcaacacctggcaattccttacc

SEQ ID NO: 36 - DNA, 41 bp, Artificial
  Primer sequence
  misc_feature (19)..(20): n is a, c, g, or t
tggaacggcggtccttgcnnsggaaacacatctccggcctc

SEQ ID NO: 37 - DNA, 18 bp, Artificial
  Primer sequence
gcaaggaccgccgttcca

SEQ ID NO: 38 - DNA, 23 bp, Artificial
  Primer sequence
  misc_feature (11)..(12): n is a, c, g, or t
cggtgaggagnnsaaggcctcgg

SEQ ID NO: 39 - DNA, 21 bp, Artificial
  Primer sequence
atgaactgtccacgttcgcgg

SEQ ID NO: 40 - DNA, 38 bp, Artificial
  Primer sequence
  misc_feature (21)..(22): n is a, c, g, or t
tgtcaatgcctggcacagacnnsaacggtaacaatcgg

SEQ ID NO: 41 - DNA, 20 bp, Artificial
  Primer sequence
gtctgtgccaggcattgaca

SEQ ID NO: 42 - DNA, 42 bp, Artificial
  Primer sequence
  misc_feature (22)..(23): n is a, c, g, or t
cccaatgactataacactcgcnnsgtttccggcggcagtgac

SEQ ID NO: 43 - DNA, 21 bp, Artificial
  Primer sequence
gcgagtgttatagtcattggg

SEQ ID NO: 44 - DNA, 2657 bp, Trichoderma reesei
cggcctcaaatcgtaaatctcggtgtgggtaggagtgcaacgatgggatttggccgcaatgctgccgagcccgagtgtttctgcaacgttatccaggagatttgcgcttgcccaagagggagttgacggggagagtcccaactggttccttcagtaacgccaccctggcagactatataacttgtggacaagactctgctttgttgagttcttcctaccagtcttgaccaagaccattctgttgagcccaatcagaaatgcgttaccgaacagcagctgcgctggcacttgccactgggccctttgctagggcagacagtcagtatagctggtccatactgggatgtatatgtatcctggagacaccatgctgactcttgaatcaaggtagctcaacatcgggggcctcggctgaggcagttgtacctcctgcagggactccatggggaaccgcgtacgacaaggcgaaggccgcattggcaaagctcaatctccaagataaggtcggcatcgtgagcggtgtcggctggaacggcggtccttgcgttggaaacacatctccggcctccaagatcagctatccatcgctatgccttcaagacggacccctcggtgttcgatactcgacaggcagcacagcctttacgccgggcgttcaagcggcctcgacgtgggatgtcaatttgatccgcgaacgtggacagttcatcggtgaggaggtgaaggcctcggggattcatgtcatacttggtcctgtggctgggccgctgggaaagactccgcagggcggtcgcaactgggagggcttcggtgtcgatccatatctcacgggcattgccatgggtcaaaccatcaacggcatccagtcggtaggcgtgcaggcgacagcgaagcactatatcctcaacgagcaggagctcaatcgagaaaccatttcgagcaacccagatgaccgaactctccatgagctgtatacttggccatttgccgacgcggttcaggccaatgtcgcttctgtcatgtgctcgtacaacaaggtcaataccacctgggcctgcgaggatcagtacacgctgcagactgtgctgaaagaccagctggggttcccaggctatgtcatgacggactggaacgcacagcacacgactgtccaaagcgcgaattctgggcttgacatgtcaatgcctggcacagacttcaacggtaacaatcggctctggggtccagctctcaccaatgcggtaaatagcaatcaggtccccacgagcagagtcgacgatatggtgactcgtatcctcgccgcatggtacttgacaggccaggaccaggcaggctatccgtcgttcaacatcagcagaaatgttcaaggaaaccacaagaccaatgtcagggcaattgccagggacggcatcgttctgctcaagaatgacgccaacatcctgccgctcaagaagcccgctagcattgccgtcgttggatctgccgcaatcattggtaaccacgccagaaactcgccctcgtgcaacgacaaaggctgcgacgacggggccttgggcatgggttggggttccggcgccgtcaactatccgtacttcgtcgcgccctacgatgccatcaataccagagcgtcttcgcagggcacccaggttaccttgagcaacaccgacaacacgtcctcaggcgcatctgcagcaagaggaaaggacgtcgccatcgtcttcatcaccgccgactcgggtgaaggctacatcaccgtggagggcaacgcgggcgatcgcaacaacctggatccgtggcacaacggcaatgccctggtccaggcggtggccggtgccaacagcaacgtcattgttgttgtccactccgttggcgccatcattctggagcagattcttgctcttccgcaggtcaaggccgttgtctgggcgggtcttccttctcaggagagcggcaatgcgctcgtcgacgtgctgtggggagatgtcagcccttctggcaagctggtgtacaccattgcgaagagccccaatgactataacactcgcatcgtttccggcggcagtgacagcttcagcgagggactgttcatcgactataagcacttcgacgacgccaatatcacgccgcggtacgagttcggctatggactgtgtaagtttgctaacctgaacaatctattagacaggttgactgacggatgactgtggaatgatagcttacaccaagttcaactactcacgcctctccgtcttgtcgaccgccaagtctggtcctgcgactggggccgttgtgccgggaggcccgagtgatctgttccagaatgtcgcgacagtcaccgttgacatcgcaaactctggccaagtgactggtgccgaggtagcccagctgtacatcacctacccatcttcagcacccaggacccctccgaagcagctgcgaggctttgccaagctgaacctcacgcctggtcagagcggaacagcaacgttcaacatccgacgacgagatctcagctactgggacacggcttcgcagaaatgggtggtgccgtcggggtcgtttggcatcagcgtgggagcgagcagccgggatatcaggctgacgagcactctgtcggtagcgtagcgcgaggagggtgaaggcggttgacctgtgac

SEQ ID NO: 45 - DNA, 33 bp, Artificial
  Primer sequence
cgcgaacgtggacagttcatcggtgaggagatg

SEQ ID NO: 46 - DNA, 33 bp, Artificial
  Primer sequence
catctcctcaccgatgaactgtccacgttcgcg

SEQ ID NO: 47 - DNA, 33 bp, Artificial
  Primer sequence
caatgcctggcacagacatcaacggtaacaatc

SEQ ID NO: 48 - DNA, 33 bp, Artificial
  Primer sequence
gattgttaccgttgatgtctgtgccaggcattg

SEQ ID NO: 49 - DNA, 25 bp, Artificial
  Primer sequence
ggcggtccttgcattggaaacacat

SEQ ID NO: 50 - DNA, 25 bp, Artificial
  Primer sequence
atgtgtttccaatgcaaggaccgcc

SEQ ID NO: 51 - DNA, 32 bp, Artificial
  Primer sequence
gactataacactcgcgacgtttccggcggcag

SEQ ID NO: 52 - DNA, 32 bp, Artificial
  Primer sequence
ctgccgccggaaacgtcgcgagtgttatagtc

SEQ ID NO: 53 - DNA, 32 bp, Artificial
  Primer sequence
gactataacactcgcaacgtttccggcggcag

SEQ ID NO: 54 - DNA, 32 bp, Artificial
  Primer sequence
ctgccgccggaaacgttgcgagtgttatagtc

SEQ ID NO: 55 - DNA, 32 bp, Artificial
  Primer sequence
gactataacactcgcctggtttccggcggcag

SEQ ID NO: 56 - DNA, 32 bp, Artificial
  Primer sequence
ctgccgccggaaaccaggcgagtgttatagtc

SEQ ID NO: 57 - DNA, 37 bp, Artificial
  Primer sequence
actgaattcttaattaagaaccgacgactcgtccgtc

SEQ ID NO: 58 - DNA, 36 bp, Artificial
  Primer sequence
gtggagctccttaaggtgacatcggcttcaaatggc

SEQ ID NO: 59 - DNA, 37 bp, Artificial
  Primer sequence
gcagagctcgcggccgcgaaccgacgactcgtccgtc

SEQ ID NO: 60 - DNA, 42 bp, Artificial
  Primer sequence
ctgggatccgatatcacgcgtgtgacatcggcttcaaatggc

SEQ ID NO: 61 - DNA, 32 bp, Artificial
  Primer sequence
tttacgcgtgattatggcgtactagagagcgg

SEQ ID NO: 62 - DNA, 39 bp, Artificial
  Primer sequence
ctgcaggaggtacaacctggcgcttctccacagccacgg

SEQ ID NO: 63 - DNA, 41 bp, Artificial
  Primer sequence
gtggagaagcgccaggttgtacctcctgcagggactccatg

SEQ ID NO: 64 - DNA, 32 bp, Artificial
  Primer sequence
tttggtaccctacgctaccgacagagtgctcg

SEQ ID NO: 65 - DNA, 30 bp, Artificial
  Primer sequence
tttgcggccgccatcattcgtcgctttcgg

SEQ ID NO: 66 - DNA, 27 bp, Artificial
  Primer sequence
ttcgatcgactataccaccacccaccg

SEQ ID NO: 67 - DNA, 29 bp, Artificial
  Primer sequence
ctgggtaccggctttcgtgaccgggcttc

SEQ ID NO: 68 - DNA, 29 bp, Artificial
  Primer sequence
ctgggatccgatggactagtacagccatg

SEQ ID NO: 69 - protein, 582 aa, Trichoderma reesei
VVPPAGTPWGTAYDKAKAALAKLNLQDKVGIVSGVGWNGGPCVGNTSPASKISYPSLCLQDGPLGVRYSTGNTAFTPGVQAASTWDVNLIRERGQFIGEEMKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDINGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRNVSGGSDSFSEGLFIDYKHFDDANITPRYEFGYGLSYTKF

SEQ ID NO: 70 - protein, 582 aa, Trichoderma reesei
VVPPAGTPWGTAYDKAKAALAKLNLQDKVGIVSGVGWNGGPCVGNTSPASKISYPSLCLQDGPLGVRYSTGNTAFTPGVQAASTWDVNLIRERGQFIGEEMKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDINGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRLVSGGSDSFSEGLFIDYKHFDDANITPRYEFGYGLSYTKF

SEQ ID NO: 71 - protein, 589 aa, Artificial
  Protein alignment consensus sequence
WGQGEWAEAYARAKDLVSQMTLAEKVNLTTGTGWELGPCVGNTGSVPRLGIPGLCLQDGPLGVRGTDYNSAFPAGVNVAATWDKNLAYLRGQAMGEEFRGKGVDVQLGPVAGPLGRSPDGGRNWEGFSPDPYLSGVLAAETIKGIQSAGVIAYAKHFIGNEQEHFRQASESSSNIDDRTLHELYLWPFADAVRAGVGSVMCSYNQVNNSYACQNSKLLNGLLKGELGFQGFVMSDWGAQHSGVGSALAGLDMSMPGDFGTSYWGTNLTNAVLNGTVPQWRLDDMATRILAAYYKVGQDDYPPPNFSSWTRDEYGYEYVNQVDVQGNHADLIRRIAAASTVLLKNDNALPLKGKEKKIAVFGEDAGSNPYGANGCSDRGCDNGTLAMGWGSGTANFPYLVTPEEAIQNVLSNKGNVSSVTDNALQIEAVASQADVAIVFVNADSGEGYITVDGNEGDRNNLTLWHNGDNLIKAVASNCNNTVVVIHSVGPVLVEEWYDHPNVTAIVWAGLPGQESGNALADVLYGRVNPSGKLPFTWGKTREDYGPSLVTPNGGPQDDFTEGVFIDYRHFDKANITPRYEFGYGLSYTTF

SEQ ID NO: 72 - protein, 626 aa, Aspergillus aculeatus
PWANGQGEWAEAYQRAVAIVSQMTLDEKVNLTTGTGWELEKCVGQTGGVPRLNIGGMCLQDSPLGIRDSDYNSAFPAGVNVAATWDKNLAYLRGQAMGQEFSDKGIDVQLGPAAGPLGRSPDGGRNWEGFSPDPALTGVLFAETIKGIQDAGVVATAKHYILNEQEHFRQVAEAAGYGFNISDTISSNVDDKTIHEMYLWPFADAVRAGVGAIMCSYNQINNSYGCQNSYTLNKLLKAELGFQGFVMSDWGAHHSGVGSALAGLDMSMPGDITFDSATSFWGTNLTIAVLNGTVPQWRVDDMAVRIMAAYYKVGRDRLYQPPNFSSWTRDEYGFKYFYPQEGPYEKVNHFVNVQRNHSEVIRKLGADSTVLLKNNNALPLTGKERKVAILGEDAGSNSYGANGCSDRGCDNGTLAMAWGSGTAEFPYLVTPEQAIQAEVLKHKGSVYAITDNWALSQVETLAKQASVSLVFVNSDAGEGYISVDGNEGDRNNLTLWKNGDNLIKAAANNCNNTIVVIHSVGPVLVDEWYDHPNVTAILWAGLPGQESGNSLADVLYGRVNPGAKSPFTWGKTREAYGDYLVRELNNGNGAPQDDFSEGVFIDYRGFDKRNETPIYEFGHGLSYTTF

SEQ ID NO: 73 - protein, 590 aa, Aspergillus fumigatus
GSWAAAYAKAKKFVAQLTPEEKVNLTAGTDANNGCSGNIAAIPRLNFPGLCVSDAGNGLRGTDYVSSWPSGLHVGASWNKALARQRAVQMATEFRKKGVNVLLGPVVGPLGRVAEAGRNWEGFSNDPYLSGALVYETVDGAQSVGVATCTKHYILNEQETNRNPGMEDGVEVAAVSSNIDDKTMHELYLWPFQDAVLAGSASIMCSYNRVNNSYGCQNSKTLNGLLKTELGFQGYVMTDWGAQHAGIAGANAGLDMVMPSTETWGANLTTAISNGTMDASRLDDMATRIIASWYQMNQDSDFPSPGAGMPSDMYAPHQRVIGRDASSKQTLLRGAIEGHVLVKNNHSALPLKSPQLLSVFGYDAKGPNALKQNFNWLSYSPAIQENHTLWVGGGSGANNAAYIDAPIDAIQRQAYEDGTSVLYDISSEDPEVDPTTDACLVFINSYATEGWDRPGLADNSSDTLVKNVARKCANTIVTIHNAGIRVVGEWIDHENVTAVIFAHLPGQDSGRALVELLYGRANPSGKLPYTVAKKVEDYGSLLHPSLPETPYGLFPQSDFDEGVYIDYRAFDRANITAQFEFGFGLSYTSF

SEQ ID NO: 74 - protein, 627 aa, Aspergillus fumigatus
PWADGQGEWADAHRRAVEIVSQMTLAEKVNLTTGTGWEMDRCVGQTGSVPRLGINWGLCGQDSPLGIRFSDLNSAFPAGTNVAATWDKTLAYLRGKAMGEEFNDKGVDILLGPAAGPLGKYPDGGRIWEGFSPDPALTGVLFAETIKGIQDAGVIATAKHYILNEQEHFRQVGEAQGYGYNITETISSNVDDKTMHELYLWPFADAVRAGVGAVMCSYNQINNSYGCQNSQTLNKLLKAELGFQGFVMSDWSAHHSGVGAALAGLDMSMPGDISFDDGLSFWGTNLTVSVLNGTVPAWRVDDMAVRIMTAYYKVGRDRLRIPPNFSSWTRDEYGWEHSAVSEGAWTKVNDFVNVQRSHSQIIREIGAASTVLLKNTGALPLTGKEVKVGVLGEDAGSNPWGANGCPDRGCDNGTLAMAWGSGTANFPYLVTPEQAIQREVISNGGNVFAVTDNGALSQMADVASQSSVSLVFVNADSGEGFISVDGNEGDRKNLTLWKNGEAVIDTVVSHCNNTIVVIHSVGPVLIDRWYDNPNVTAIIWAGLPGQESGNSLVDVLYGRVNPSAKTPFTWGKTRESYGAPLLTEPNNGNGAPQDDFNEGVFIDYRHFDKRNETPIYEFGHGLSYTTF

SEQ ID NO: 75 - protein, 626 aa, Aspergillus kawachii
PWANGQGDWAQAYQRAVDIVSQMTLAEKVNLTTGTGWELELCVGQTGGVPRLGVPGMCLQDSPLGVRDSDYNSAFPSGMNVAATWDKNLAYLRGKAMGQEFSDKGADIQLGPAAGPLGRSPDGGRNWEGFSPDPALSGVLFAETIKGIQDAGVVATAKHYIAYEQEHFRQAPEAQGYGFNISESGSANLDDKTMHELYLWPFADAIRAGAGAVMCSYNQINNSYGCQNSYTLNKLLKAELGFQGFVMSDWAAHHAGVSGALAGLDMSMPGDVDYDSGTSYWGTNLTVSVLNGTVPQWRVDDMAVRIMAAYYKVGRDRLWTPPNFSSWTRDEYGYKYYYVSEGPYEKVNHYVNVQRNHSELIRRIGADSTVLLKNDGALPLTGKERLVALIGEDAGSNPYGANGCSDRGCDNGTLAMGWGSGTANFPYLVTPEQAISNEVLKNKNGVFTATDNWAIDQIEALAKTASVSLVFVNADSGEGYINVDGNLGDRKNLTLWRNGDNVIKAAASNCNNTIVIIHSVGPVLVNEWYDNPNVTAILWGGLPGQESGNSLADVLYGRVNPGAKSPFTWGKTREAYQDYLVTEPNNGNGAPQEDFVEGVFIDYRGFDKRNETPIYEFGYGLSYTTF

SEQ ID NO: 76 - protein, 585 aa, Aspergillus nidulans
ALPIYKNASYCVDERVRDLLSRMTLEEKAGQLFHKQLSEGPLDDDSSGNSTETMIGKKHMTHFNLASDITNATQTAEFINLIQKRALQTRLGIPITISTDPRHSFTENVGTGFQAGVFSQWPESLGLAALRDPQLVREFAEVAREEYLAVGIRAALHPQVDLSTEPRWARISGTWGENSTLTSELIVEYIKGFQGEGKLGPKSVKTVTKHFPGGGPMENGEDSHFYYGKNQTYPGNNIDEHLIPFKAALAAGATEIMPYYSRPIGTNWEAVGFSFNKEIVTDLLRGELGFDGIVLTDWGLITDTYIGNQYMPARAWGVEYLSELQRAARILDAGCDQFGGEERPELIVQLVREGTISEDRIDVSVARLLKEKFLLGLFDNPFVNASAANNIVGNEHFVNLGRDAQRRSYTLLTNNQTILPLAKPGEGTRFYIEGFDSAFMSARNYTVVNTTEEADFALLRYNAPYEPRNGTFEANFHAGSLAFNATEKARQAKIYSSLPTIVDIILDRPAVIPEVVEQAQAVLASYGSDSEAFLDVVFGVSKPEGKLPFDLPRSMDAVEAQAEDLPFDTENPVFRYGHGLEYEDN

SEQ ID NO: 77 - protein, 718 aa, Aspergillus nidulans
AQIESVLSKLTLEEKISLLAGKNFWETQDYPEKGVPPVKTSDGPNGARGATFKGGVTAACFPASSLLAATWDLDAAKHIGEALADETRSKGARVLLAPTVCIHRHPLGGRNFESFSEDPFLAGKLAAQYIKGLQGNGVAATIKHYAANEQETCRFTVNEHITERALREIYLKPFEIAIKESNPLAVMTAYNIVNGTHADSNNFLLRDVLRGEWGWKGLVMSDWGGTNSTADALNAGLDLEMPGPTRWRKVDEVLAVVKSGAVLEETIDERARNVLELLAKLNCFENPTIPEEKAINRPEHQKLIRSVGSQGLVLLKNEGDVLPLRKEILTNKKVALLGFAREALIHGGGSASVNAHYRVTPEEGLRAALGDTVEFEYAKGAHTFRQLPLMSDNVVNLEGQPGWTLDFFADEEPNGEPGSSISSEQPSYIPLFVKESWGSVRASAHFTPTQSGKHYFGMSGLGRSKLLIDGEVIYEQKLNCPDSMGFLLGGVEEPEIQYSFEAGKTYAVEVVSVKPTSKGGLALLDGFIGFRLGFMTEEEHNRDLLSEAVDVAKRSDIAIVFTGHTPDWETEGQDQISFHLPSNGSQDRLVAAVGAANPNTVVVNCTGVAVAMPWLDKVKAVVQAWFPGQEAGNAIADVLTGAVNPSGRLPVSFPRAIEDAPAHGNFPGDYTDGKDNRRHLEVTYKEGVFVGYRHYDLSEANRAKVLFPFGYGLSYTTF

SEQ ID NO: 78 - protein, 626 aa, Aspergillus niger
PWANGQGDWAQAYQRAVDIVSQMTLDEKVNLTTGTGWELELCVGQTGGVPRLGVPGMCLQDSPLGVRDSDYNSAFPAGMNVAATWDKNLAYLRGKAMGQEFSDKGADIQLGPAAGPLGRSPDGGRNWEGFSPDPALSGVLFAETIKGIQDAGVVATAKHYIAYEQEHFRQAPEAQGFGFNISESGSANLDDKTMHELYLWPFADAIRAGAGAVMCSYNQINNSYGCQNSYTLNKLLKAELGFQGFVMSDWAAHHAGVSGALAGLDMSMPGDVDYDSGTSYWGTNLTISVLNGTVPQWRVDDMAVRIMAAYYKVGRDRLWTPPNFSSWTRDEYGYKYYYVSEGPYEKVNQYVNVQRNHSELIRRIGADSTVLLKNDGALPLTGKERLVALIGEDAGSNPYGANGCSDRGCDNGTLAMGWGSGTANFPYLVTPEQAISNEVLKHKNGVFTATDNWAIDQIEALAKTASVSLVFVNADSGEGYINVDGNLGDRRNLTLWRNGDNVIKAAASNCNNTIVVIHSVGPVLVNEWYDNPNVTAILWGGLPGQESGNSLADVLYGRVNPGAKSPFTWGKTREAYQDYLVTEPNNGNGAPQEDFVEGVFIDYRGFDKRNETPIYEFGYGLSYTTF

SEQ ID NO: 79 - protein, 626 aa, Aspergillus niger
PWANGQGDWAEAYQRAVDIVSQMTLAEKVNLTTGTGWELELCVGQTGGVPRLGIPGMCAQDSPLGVRDSDYNSAFPAGVNVAATWDKNLAYLRGQAMGQEFSDKGADIQLGPAAGPLGRSPDGGRNWEGFSPDPALSGVLFAETIKGIQDAGVVATAKHYIAYEQEHFRQAPEAQGYGFNITESGSANLDDKTMHELYLWPFADAIRAGAGAVMCSYNQINNSYGCQNSYTLNKLLKAELGFQGFVMSDWAAHHAGVSGALAGLDMSMPGDVDYDSGTSYWGTNLTISVLNGTVPQWRVDDMAVRIMAAYYKVGRDRLWTPPNFSSWTRDEYGFKYYYVSEGPYEKVNQFVNVQRNHSELIRRIGADSTVLLKNDGALPLTGKERLVALIGEDAGSNPYGANGCSDRGCDNGTLAMGWGSGTANFPYLVTPEQAISNEVLKNKNGVFTATDNWAIDQIEALAKTASVSLVFVNADSGEGYINVDGNLGDRRNLTLWRNGDNVIKAAASNCNNTIVIIHSVGPVLVNEWYDNPNVTAILWGGLPGQESGNSLADVLYGRVNPGAKSPFTWGKTREAYQDYLYTEPNNGNGAPQEDFVEGVFIDYRGFDKRNETPIYEFGYGLSYTTF

SEQ ID NO: 80 - protein, 626 aa, Aspergillus oryzae
PWADGQGEWAEVYKRAVDIVSQMTLTEKVNLTTGTGWQLERCVGQTGSVPRLNIPSLCLQDSPLGIRFSDYNSAFPAGVNVAATWDKTLAYLRGQAMGEEFSDKGIDVQLGPAAGPLGAHPDGGRNWEGFSPDPALTGVLFAETIKGIQDAGVIATAKHYIMNEQEHFRQQPEAAGYGFNVSDSLSSNVDDKTMHELYLWPFADAVRAGVGAVMCSYNQINNSYGCENSETLNKLLKAELGFQGFVMSDWTAHHSGVGAALAGLDMSMPGDVTFDSGTSFWGANLTVGVLNGTIPQWRVDDMAVRIMAAYYKVGRDTKYTPPNFSSWTRDEYGFAHNHVSEGAYERVNEFVDVQRDHADLIRRIGAQSTVLLKNKGALPLSRKEKLVALLGEDAGSNSWGANGCDDRGCDNGTLAMAWGSGTANFPYLVTPEQAIQNEVLQGRGNVFAVTDSWALDKIAAAARQASVSLVFVNSDSGESYLSVDGNEGDRNNITLWKNGDNVVKTAANNCNNTVVIIHSVGPVLIDEWYDHPNVTGILWAGLPGQESGNSIADVLYGRVNPGAKSPFTWGKTRESYGSPLVKDANNGNGAPQSDFTQGVFIDYRHFDKFNETPIYEFGYGLSYTTF

SEQ ID NO: 81 - protein, 626 aa, Aspergillus oryzae
PWADGQGEWAEVYKRAVDIVSQMTLTEKVNLTTGTGWQLERCVGQTGSVPRLNIPSLCLQDSPLGIRFSDYNSAFPAGVNVAATWDKTLAYLRGQAMGEEFSDKGIDVQLGPAAGPLGAHPDGGRNWEGFSPDPALTGVLFAETIKGIQDAGVIATAKHYIMNEQEHFRQQPEAAGYGFNVSDSLSSNVDDKTMHELYLWPFADAVRAGVGAVMCSYNQINNSYGCENSETLNKLLKAELGFQGFVMSDWTAHHSGVGAALAGLDMSMPGDVTFDSGTSFWGANLTVGVLNGTIPQWRVDDMAVRIMAAYYKVGRDTKYTPPNFSSWTRDEYGFAHNHVSEGAYERVNEFVDVQRDHADLIRRIGAQSTVLLKNKGALPLSRKEKLVALLGEDAGSNSWGANGCDDRGCDNGTLAMAWGSGTANFPYLVTPEQAIQNEVLQGRGNVFAVTDSWALDKIAAAARQASVSLVFVNSDSGEGYLSVDGNEGDRNNITLWKNGDNVVKTAANNCNNTVVIIHSVGPVLIDEWYDHPNVTGILWAGLPGQESGNSIADVLYGRVNPGAKSPFTWGKTRESYGSPLVKDANNGNGAPQSDFTQGVFIDYRHFDKFNETPIYEFGYGLSYTTF

SEQ ID NO: 82 - protein, 615 aa, Aspergillus oryzae
PNGGWISEWASAYEKAHRVVSNMTLAEKVNLTSGTGIYMGPCAGQTGSVPRFGIPNLCLHDSPLGVRNSDHNTAFPAGITVGATFDKDLMYERGVGLGEEARGKGINVLLGPSVGPIGRKPRGGRNWEGFGADPSLQAFGGSLTIKGMQSTGAIASLKHLIGNEQEQHRMSSVITQGYSSNIDDRTLHELYLWPFAESVRAGAGSVMIAYNDVNRSACSQNSKLINGILKDELGFQGFVVTDWLAHIGGVSSALAGLDMSMPGDGAIPLLGTSYWSWELSRSVLNGSVPVERLNDMVTRIVATWYKMGQDKDYPLPNFSSNTEDETGPLYPGALFSPSGIVNQYVNVQGNHNVTARAIARDAITLLKNNENVLPLKRNDTLKIFGTDAGTNSDGINSCTDKGCNKGVLTMGWGSGTSRLPYLITPQEAIANISSNAEFHITDTFPLGVTAGPDDIAIVFINSDSGENYITVDGNPGDRTLAGLHAWHNGDNLVKAAAEKFSNVVVVVHTVGPILMEEWIDLDSVKAVLVAHLPGQEAGWSLTDILFGDYSPSGHLPYTIPHSESDYPESVGLIAQPFGQIQDDYTEGLYIDYRHFLKANITPRYPFGHGLSYTTF

SEQ ID NO: 83 - protein, 631 aa, Aspergillus oryzae
PETKGLGDWEEAFTKARSLVAQMTDKEKNNITYGYSSTANGCGGTSGGVPRLGFPGICLQDAGNGVRGTDMVNSYASGVHVGASWNRDLTYSRAQYMGAEFKRKGVNVALGPVAGPIGRIARGGRNWEGFSNDPYLSGALTGDTVRGLQESVIACVKHLIGNEQETHRSTPSMLANSRNQSSSSNLDDKTMHELYLWPFQDAVKAGAGSVMCSYNRINNSYGCQNSKAMNGLLKGELGFQGFVVSDWGAQHTGIASAAAGLDMAMPSSSYWENGTLALAVKNESLPSTRLDDMATRIVATWYKYAEIENPGHGLPYSLLAPHNLTDARDPKSKSTILQGAVEGHVLVKNTNNALPLKKPQFLSLFGYDAVAAARNTMDDLDWNMWSMGYDNSLTYPNGSAVDAMMLKYIFLSSANPSAFGPGVALNATTITGGGSGASTASYIDAPFNAFQRQAYDDDTFLAWDFASQNPLVNPASDACIVFINEQSSEGWDRPYLADPYSDTLVQNVASQCSNTMVVIHNAGVRLVDRWIENDNITAVIYAHLPGQDSGRALVEVMYGKQSPSGRLPYTVAKNESDYGSLLNPVIQSGTDDIYYPQDNFTEGVYIDYKAFVAANITPRYEFGYGLTYSTF

SEQ ID NO: 84 - protein, 633 aa, Botryotinia fuckeliana
RASTSFQNWTHAHHLALTFVNQLNITEKSNIVTGTYHTSTLDGKPMNCIGNIGPIPRLNFTGICLNDGPALLLVRDLISVFPSGVTLAATWDRELVYQSYKALGEEFRGKGTHVALGPVAGPLGRHPLGGRNWEGFSPDPYLTGHLMTASITGMQSVGVQTSSKHFIGNEQETQRSNSPLPDGTNIDAISSNIDDRTLHELYLWPFADAVRAGTTSILCSYNRINETYACENPHLLNNILKGELGFQGYVVSDWFATHSGYPAANAGLDMDMPGYISQSAINTGETYFGPHLISAIQAGNMTEDRLDDMVTRIMTSYFLLNQSSNYPTPDPSQTYVMANMYGYDYGAQIPARDVRANHSSLIRQIGSAGTVLLKNTNNILPLSKPLNIGVFGNSAPDPTDGLTWPQSDLQTGFDIGTLDIGGGSGSARHTTLISPLTALRTRAATYARVQYLTNNALLSSSSSSSFAGIYPIPEICLVFLKTFSSEGVDRTSYPLDWNSTLVVNNVASFCQGNTIVITHSSGINTLPFAQNPNVSAILLAHYPGQESGNSIVDVLFGVVNPSGKLPYTIPVHESDMHIPVVNLSTSEVLAHHQSQNAWQSNFTEKLAIDYRGFEMKNVTPLYEFGHGLSYTTF

SEQ ID NO: 85 - protein, 626 aa, Coccidioides posadasii
PWASGQGEWSEAYNKAREFVSQLTLTEKVNLTTGVGWMQEACVGNVGSIPRLGFRSLCMQDGPLGIRFADHVSAFPAGINVGATWSKSLAYLRGKAMGEEHRDKGVDVQLGPAVGPLGRSPDGGRNWEGFSPDPVLSGYLVAETIKGIQDAGVIACVKHFIVNEQERFRQAPEAQGYGFNISESSSSNVDDVTMHELYLWPFADAVRAGVGSVMCSYNQINNSYGCSNSYTQNKLLKGELGFQGFIMSDWQAHHSGVGDDLAGLDMSMPGDTLFLTGKSYWGPNLTIAVTNGTIPQWRLDDMAVRIMAAYYKVRRDQTQVPINFNSWTRDEFGYLHAGGQEGYGRVNQMVNVRGRHAVIARKVASASTVLLKNRGVLPLKGKEKLTAVIGEDAGPNLWGPNGCPDRGCANGTLAMGWGSGTADFPYLVTPAQAIENEVITKGVGEAMSVFDNYATSQIESVVSQATVSLVFVNAGAGEGFISVDGNEGDRKNLTLWKNGDELIKTVASMCNNTVVVMHTAGPVLVNKWYDHPNVTAILWAGLPGQESGNALGDVIYGRVNPGAKSPFTWAATSEDYGVSILKEPNAATKAPQIDFEEGIFIDYRAFDKSNTKPIYEFGFGLSYTTF

SEQ ID NO: 86 - protein, 604 aa, Coccidioides posadasii
EAYSKAHTVVSKMTLAGKVNLTTGTGFLMALVGQTGSALRFGIPRLCLQDGPLGLRNTDHNTAFPAGISVGATFDKKLMYERGCAMGEEFRGKGANVHLGPSVGPLGRKPRGGRNWEGFGSDPSLQAIAAVETIKGVQSKGVIATIKHLVGNEQEMYRMTNIVQRAYSANIDDRTMHELYLWPFAESVRAGVGAVMMAYNDVNGSASCQNSKLINGILKDELGFQGFVMTDWYAQIGGVSSALAGLDMSMPGDGSVPLSGTSFWASELSRSILNGTVALDRLNDMVTRIVATWFKFGQDKDFPLPNFSSYTQNAKGLLYPGALFSPLGVVNQFVNVQADHHKLARVIARESITLLKNEDNLLPLDPNRAIKYSEQMPGTNPRGINACPDKGCNKGVLTMGWGSGTSNLPYLVTPEDAIRNISKNTEFHITDKFPNNVQPGPDDVAIVFVNADSGENYIIVESNPGDRTVAQMKLWHNGDELIESAAKKFSNVVVVVVHTVGPIIMEKWIDLLRSRVSCLPDFQDKKLEILLLISCSETSVRVAASIYDTESRIGLSDSVSLINQRFGQIQDTFTEGLFIDYRHFQKENITPRYHFGYGLSYTTF

SEQ ID NO: 87 - protein, 644 aa, Dictyostelium discoideum
SQIYPKKQLNQENINFMSARDTFVDNLMSKMSITEKIGQMTQLDITTLTSPNTITINETTLAYYAKTYYIGSYLNSPVSGGLAGDIHHINSSVWLDMINTIQTIVIEGSPNKIPMIYGLDSVHGANYVHKATLFPHNTGLAATFNIEHATTAAQITSKDTVAVGIPWVFAPVLGIGVQPLWSRIYETFGEDPYVASMMGAAAVRGFQGGNNSFDGPINAPSAVCTAKHYFGYSNPTSGKDRTAAWIPERMLRRYFLPSFAEAITGAGAGTIMINSGEVNGVPMHTSYKYLTEVLRGELQFEGVAVTDWQDIEKLVYFHHTAGSAEEAILQALDAGIICLCHDLLSQLFSLEILAAGTVPESRLDLSVRRILNLKYALGLFSNPYPNPNAAIVDTIGQVQDREAAAATAEESITLLLFKNNILPLNTNTIKNVLLTGPSADSIRNLNGGWSVHWQGAYEDSEFPFGTSILTGLREITNDTADFNIQYTIGHEIGVPTNQTSIDEAVELAQSSDVVVVVIGELPEAETPGDIYDLSMDPNEVLLLQQLVDTGKPVVLILVEARPRILPPDLVYSCAAVLMAYLPGSEGGKPIANILMGNVNPSGRLPLTYPGTTGDIGVPYYHKYSENGVTTPLFQFGDGLSYTTF

SEQ ID NO: 88 - protein, 600 aa, Hordeum vulgare
DYLKYKDPKQPLGVRIKDLLGRMTLAEKIGQMTQIERENATAEAMSKYFIGSVLSGGGSVPSPQASAAAWQSMVNEMQKGALSTRLGIPMIYGIDAVHGHNNVYKATIFPHNVGLGATRDPMLVKRIGEATALEVRATGIPYAFAPCIAVCRDPRWGRCYESYSEDPKVVQSMTTLISGLQGDVPAGSEGRPYVGGSKKVAACAKHYVGDGGTFMGINENDTIIDAHGLMTIHMPAYYNSIIRGVSTVMTSYSSWNGKKMHANHFLVTDFLKNKLKFRGFVISDWQGIDRITSPPGVNYSYSVEAGVGAGIDMIMVPFAYTEFIDDLTYQVKNNIIPMSRINDAVYRILRVKFTMGLFESPYADPSLVGELGKQEHRDLAREAVRKSLVLLKNGKSASTPLLPLPKKAGKILVAGSHADDLGNQCGGWTITWQGQTGNDKTAGTTILSAIKSTVDPSTEVVFSENPDSAAVDSGKYDYAIVVVGEPPYAETFGDNLNLTIPAPGPSVIQNVCKSVRCVVVLISGRPLVVEPYISAMDAFVAAWLPGSEGQGVADVLFGDYGFSGKLARTWFKSADQLPMNVGDKHYDPLFPFGFGLTTEA

SEQ ID NO: 89 - protein, 703 aa, Hypocrea jecorina
VEAILKKLTLAEKVDLLAGIDFWHTKALPKHGVPSLRFTDGPNGVRGTKFFNGVPAACFPCGTSLGSTFNQTLLEEAGKMMGKEAIAKSAHVILGPTINMQRSPLGGRGFESIGEDPFLAGLGAAALIRGIQSTGVQATIKHFLCNDQEDRRMMVQSIVTERALREIYALPFQIAVRDSQPGAFMTAYNGINGVSCSENPKYLDGMLRKEWGWDGLIMSDWYGTYSTTEAVVAGLDLEMPGPPRFRGETLKFNVSNGKPFIHVIDQRAREVLQFVKKCAASGVTENGPETTVNNTPETAALLRKVGNEGIVLLKNENNVLPLSKKKKTLIVGPNAKQATYHGGGSAALRAYYAVTPFDGLSKQLETPPSYTVGAYTTVPPILGEQCLTPDGAPGMRWRVFNEPPGTPNRQHIDELFFTKTDMHLVDYYHPKAADTWYADMEGTYTADEDCTYELGLVVCGTAKAYVDDQLVVDNATKQVPGDAFFGSATREETGRINLVKGNTYKFKIEFGSAPTYTLKGDTIVPGHGSLRVGGCKVIDDQAEIEKSVALAKEHDQVIICAGLNADWETEGADRASMKLPGVLDQLIADVAAANPNTVVVMQTGTPEEMPWLDATPAVIQAWYGGNETGNSIADVVFGDYNPSGKLSLSFPKRLQDNPAFLNFRTEAGRTLYGEDVYVGYRYYEFADKDVNFPFGHGLSYTTF

SEQ ID NO: 90 - protein, 602 aa, Hypocrea jecorina
GPWAHAYRRAEKLVRQMTLEEKANITRGFTGDNVCAGNTGSVPRLGWPGMCVHDAGNGVRATDLVNSYPSGIHVGASWDRNLTYERGLHMGGEFKAKGVNVPLGPNAGPLGRTPLGGRNWEGFSIDPYLSGQLNAETITGMQDAGVIANIKHFIANEQETLRRPYFGVEAVSANIDDRTLHEYYLWPFMDSVHAGVGSVMCSYNRINNTYGCMNDKLMNGILKAELGFQGFVMLDWNAQHDLQSANAGLDMVMPLGGSWGKNLTDAVANGTVSESRITDMATRIIAAWYLVGQDGNNFPVPGIGLKQLTKPHEQVDARDPASKPVLLEGAIAGHVLVKNENNALPFNKKLTMISVFGYDATIPRTKNTDILFQLGYTSSPEMAQAVLGNEAHFDQAAKGGTIMTGGRAGANAPSYIDDPLAAIQRRARKDDTWVNWDLDSFNPEVNAASDACLVFINAIATEGWDRDGLHDDFSDGLVLNVAANCSNTIVVVHAAGTRLVDQWIEHPNVTAAVIAHLPGQDSGRALVKLLYGEANFSGKLPYTIAKNESDYSVYTPCQRRSPEDTDPQCDFTEGVYLDYRAFDANNMTPRFEFGYGLSYTSF

SEQ ID NO: 91 - protein, 574 aa, Hypocrea jecorina
MILGCESTGVISAVKHFVANDQEHERRAVDCLITQRALREVYLRPFQIVARDARPGALMTSYNKVNGKHVADSAEFLQGILRTEWNWDPLIVSDWYGTYTTIDAIKAGLDLEMPGVSRYRGKYIESALQARLLKQSTIDERARRVLRFAQKASHLKVSEVEQGRDFPEDRVLNRQICGSSIVLLKNENSILPLPKSVKKVALVGSHVRLPAISGGGSASLVPYYAISLYDAVSEVLAGATITHEVGAYAHQMLPVIDAMISNAVIHFYNDPIDVKDRKLLGSENVSSTSFQLMDYNNIPTLNKAMFWGTLVGEFIPTATGIWEFGLSVFGTADLYIDNELVIENTTHQTRGTAFFGKGTTEKVATRRMVAGSTYKLRLEFGSANTTKMETTGVVNFGGGAVHLGACLKVDPQEMIARAVKAAADADYTIICTGLSGEWESEGFDRPHMDLPPGVDTMISQVLDAAPNAVVVNQSGTPVTMSWAHKAKAIVQAWYGGNETGHGISDVLFGNVNPSGKLSLSWPVDVKHNPAYLNYASVGGRVLYGEDVYVGYKFYDKTEREVLFPFGHGLSYATF

SEQ ID NO: 92 - protein, 633 aa, Hypocrea jecorina
WMDPSAPGWEQAYAQAKEFVSGLTLLEKVNLTTGVGWMGEKCVGNVGTVPRLGMRSLCMQDGPLGLRFNTYNSAFSVGLTAAASWSRHLWVDRGTALGSEAKGKGVDVLLGPVAGPLGRNPNGGRNVEGFGSDPYLAGLALADTVTGIQNAGTIACAKHFLLNEQEHFRQVGEANGYGYPITEALSSNVDDKTIHEVYGWPFQDAVKAGVGSFMCSYNQVNNSYACQNSKLINGLLKEEYGFQGFVMSDWQAQHTGVASAVAGLDMTMPGDTAFNTGASYFGSNLTLAVLNGTVPEWRIDDMVMRIMAPFFKVGKTVDSLIDTNFDSWTNGEYGYVQAAVNENWEKVNYGVDVRANHANHIREVGAKGTVIFKNNGILPLKKPKFLTVIGEDAGGNPAGPNGCGDRGCDDGTLAMEWGSGTTNFPYLVTPDAALQSQALQDGTRYESILSNYAISQTQALVSQPDAIAIVFANSDSGEGYINVDGNEGDRKNLTLWKNGDDLIKTVAAVNPKTIVVIHSTGPVILKDYANHPNISAILWAGAPGQESGNSLVDILYGKQSPGRTPFTWGPSLESYGVSVMTTPNNGNGAPQDNFNEGAFIDYRYFDKVAPGKPRSSDKAPTYEFGFGLSWSTF

SEQ ID NO: 93 - protein, 586 aa, Hypocrea jecorina
KNNLVCDSSAGYVERAQALISLFTLEELILNTQNSGPGVPRLGLPNYQVWNEALHGLDRANFATKGGQFEWATSFPMPILTTAALNRTLIHQIADIISTQARAFSNSGRYGLDVYAPNVNGFRSPLWGRGQETPGEDAFFLSSAYTYEYITGIQGGVDPEHLKVAATVKHFAGYDLENWNNQSRLGFDAIITQQDLSEYYTPQFLAAARYAKSRSLMCAYNSVNGVPSCANSFFLQTLLRESWGFPEWGYVSSDCDAVYNVFNPHDYASNQSSAAASSLRAGTDIDCGQTYPWHLNESFVAGEVSRGEIERSVTRLYANLVRLGYFDKKNQYRSLGWKDVVKTDAWNISYEAAVEGIVLLKNDGTLPLSKKVRSIALIGPWANATTQMQGNYYGPAPYLISPLEAAKKAGYHVNFELGTEIAGNSTTGFAKAIAAAKKSDAIIYLGGIDNTIEQEGADRTDIAWPGNQLDLIKQLSEVGKPLVVLQMGGGQVDSSSLKSNKKVNSLVWGGYPGQSGGVALFDILSGKRAPAGRLVTTQYPAEYVHQFPQNDMNLRPDGKSNPGQTYIWYTGKPVYEFGSGLFYTTF

SEQ ID NO: 94 - protein, 718 aa, Kluyveromyces fragilis
VEQLLSELNQDEKISLLSAVDFWHTKKIERLGIPAVRVSDGPNGIRGTKFFDGVPSGCFPNGTGLASTFDRDLLETAGKLMAKESIAKNAAVILGPTTNMQRGPLGGRGFESFSEDPYLAGMATSSVVKGMQGEGIAATVKHFVCNDLEDQRFSSNSIVSERALREIYLEPFRLAVKHANPVCIMTAYNKVNGDHCSQSKKLLIDILRDEWKWDGMLMSDWFGTYTTAAAIKNGLDIEFPGPTRWRTRALVSHSLNSREQITTEDVDDRVRQVLKMIKFVVDNLEKTGIVENGPESTSNNTKETSDLLREIAADSIVLLKNKNNYLTSKERRQYHVIGPNAKAKTSSGGGSASMNSYYVVSPYEGIVNKLGKEVDYTVGAYSHKSIGGLAESSLIDAAKPADAENAGLIAKFYSNPVEERSEDEEPFHVTKVNRSNVHLFDFKHEKVDPKNPYFFVTLTGQYVPQEDGDYIFSLQVYGSGLFYLNDELIIDQKHNQERGSFCFGAGTKERTKKLTLKKGQVYNVRVEYGSGPTSGLVGEFGAGGFQAGVIKAIDDDEEIRNAAELAAKHDKAVLIIGLNGEWETEGYDRENMDLPKRTNELVRAVLKANPNTVIVNQSGTPVEFPWLEEANALVQAWYGGNELGNAIADVLYGDVVPNGKLSLSWPFKLQDNPAFLNFKTEFGRVVYGEDIFVGYRYYEKLQRKVAFPFGYGLSYTTF

SEQ ID NO: 95 - protein, 591 aa, Kuraishia capsulata
PEISGLGDWQFAYQRAREIVALMTNEEKTNLTFGSSGDTGCSGMISDVPDVDFPGLCLQDAGNGVRGTDMVNAYASGLHVGASWNRQLAYDRAVYMGAEFRHKGVNVLLGPVVGPIGRVATGGRNWEGFTNDPYLAGALVYETTKGIQENVIACTKHFIGNEQETNRNPSGTYNQSVSANIDDKTMHELYLWPFQDSVRAGLGSIMGSYNRVNNSYACKNSKVLNGLLKSELGFQGFVVSDWGGQHTGIASANAGLDMAMPSSTYWEEGLIEAVKNGTVDQSRLDDMATRIIAAWYKYARLDDPGFGMPVSLAEDHELVDARDPAAASTIFQGAVEGHVLVKNENALPLKKPKYISLFGYDGVSTDVNTVGGGFSFFSFDVKAIENKTLISGGGSGTNTPSYVDAPFNAFVAKAREDNTFLSWDFTSAEPVANPASDACIDFINAAASEGYDRPNLADKYSDKLVEAVASQCSNTIVVIHNAGIRLVDNWIEHENVTGVILAHLPGQDTGTSLIEVLYGNQSPSGRLPYTVAKKASDYGGLLWPTEPEGDLDLYFPQSNFTEGVYIDYKYFIQKNITPRYEFGYGLTYTTF

SEQ ID NO: 96 - protein, 605 aa, Nicotiana tabacum
EYVKYKDPKQPVGARIKDLMKRMTLEEKIGQMTQIERKVATADVMKQNFIGSVLSGGGSVPAPKASAQVWTNMVDEIQKGSLSTRLGIPMIYGIDAVHGHNNVYGATIFPHNVGLGVTRDPDLVKRIGAATALEVRATGIPYAFAPCIAVCRNPRWGRCYESYSEDHRIVRSMTEIIPGLQGDLPAKSKNGVPYVGGKTKVAACAKHFVGDGGTLHGVDESNTVISSNSLFSIHMPAYYDSLRKGVATVMVSYSSWNGRKMHANRDLVTGFLKDKLKFRGFVISDWQGIDRITDPPHANYSYSVQAGIMAGIDMIMVPENYREFIDTLTSQVKANIIPMSRIDDAVKRILRVKFVMGLFENPMSDPSLANQLGSQEHRELAREAVRKSLVLLKNGKTPSQPLLPLPKKAPKILVAGTHADNLGYQCGGWTIEWQGVAGNDLTIGTTILTAIKKTVDPSTQVVYQQNPDANFVKSNKFSYAIVVVGEVPYAEMFGDSSNLTIAEPGPSTISNICGSVKCVVVVVSGRPVVLEPYVSKMDALVAAWLPGTEGQGVADALFGDYGFTGKLARTWFKRVDQLPMNFDDAHVDPLFPFGFGITTKPVKGY

SEQ ID NO: 97 - protein, 601 aa, Periconia sp.
PWMDPSAAGWAEAYTKAQAFVRQLTLLEKVNLTTGVGWEGEACVGNTGSIPRLGFPGFCTQDSPLGVRFADYVSAFTAGGTIAASWDRSEFYRRGYQMGVEHRGKGVDVQLGPVVGPIGRHPKGGRNWEGFSPDPVLSGIAVAETVKGIQDAGVIACTKHFILNEQEHFRQPGNVGDFGFVDAVSANLADKTLHELYLWPFADAVRAGTGSIMCSYNKANNSQVCQNSYLQNYILKGELGFQGFTMSDWDAQHSGVASTLAGLDMNMPGDTDFDSGFSFWGPNMTLSIINGTVPEWRLDDAATRIMAAYYLVGRDRHAVPVNFNSWSKDTYGYQHAYAKVGYGLINQHVDVRADHFKSIRTAAAKSTVLLKNNGVLPLKGTEKYTAVFGNDAGEAQYGPNGCADHGCDNGTLAMGWGSGTADYPYLVTPLEAIKRTVGDHGGVIASVTDNYAFSQIMALAKQATHAIVFVNADSGEGYITVDGNEGDRNNLTLWQNGEELVRNVSGYCNNTIVVIHSVGPVLVDSFNNSPNVSAILWAGLPGQESGNAITDVLYGRVNPGGKLPFTIGKSAEEYGPDIIYEPTAGHGSPQANFEEGVFIDY

SEQ ID NO: 98 - protein, 623 aa, Phaeosphaeria avenaria
PWIEGLGDWEAAYQKAQAFVSQLTLLEKVNLTTGTGWQSDHCVGNTGGVPRLNFTGICNQDAPLGVRFADYVSAFPSGGTIAAAWDRGEWYLRGYQMGSEHRSKGVDVQLGPVVGPLGRNPKGGRNWEGFSPDPYLSGIASAESVRGIQDAGVIACTKHYIMNEQEHFRQPGNFEDQGFVDALSSNLDDKTLHELYLWPFADAVRAGTGSIMCSYNKVNNSQACQNSYLQNYILKGELGFQGFIMSDWDAQHSGVASTFAGLDMTMPGDTDFNSGKTFWGTNFTTSILNGTVPQWRLDDAVTRIMAAFYYVGRDKARIPVNFDSWSRDTYGFDHYYGKAGYSQINSHVDVRADHFRSIRRTAAMSTVLLKNEGALPLTGSEKWTAVFGDDAGEGQLGPNGFPDHGGNNGTLAMGWGSGTSDYPYLVTPLESIKATVAQNGGIVTSVTDNWAYTQIQTLAKQASVAIVFVNADSGEGYITVDGNAGDRNNLTLWQDGDTLIKNVSSLCNNTIVVIHSVGPVLVNSFYDSENVTAILWAGLPGQESGNAIADILYGRHNPGGKLPFTIGSDAAEYGPDLIYEPTNNSSSPQDNFEEGVFIDYRAFDKQNVTPIYEFGFGLSYTKF

SEQ ID NO: 99 - protein, 594 aa, Phanerochaete chrysosporium
TVANVSPEWAAAYVKAQAAVAKLSVTDMVNLATGVQWEKGPCVGNTPAISSIPGFTGLCLQDSPVGVRYADGTSVFPPEINVAATWNRTLMRQRGAAMGAEFKGKGVHVALGPMMNLMRVPAAGRNWEGGGGDPFLSGELAFETITGIQSSGAQACAKHFINNEQEHFRDSSSSNVDDRTEHELYGHPFLRSVQANVASVMCSYNQINGTFSCENEKTLSGLLKGEYGFQGYVMSDWWATHSGAPAVNAGLDMTMPGDETTNSGTTYFGQNLVNAVNSGQVSQARIKDMATRILAAWYLLGQDQNFPAVNFNSWNSGQGQHVNVSGNHASLIRTIGAASQILLKNVNGALPLKKPKTIGIIGNGAGSNPSGPNAFSDRAGDVGVLALGWGSGTANFPYLVAPVDAITARASQDGTTVSSSLSDTDLTGAANTATGKDVAMVFITADSGEGYLTVEGNAGDRNDLQAWHGGDALVQQVASHNKNTIVVINSVGPINMEAWVNHPNVTAIVWSGLPGQEAGNAVTDVLFGAVNPGGKLPFTIGKSISDYSAQIITTGSGIVPIPYNEGLFIDYRHFDQAGIAPRFEFGFGLSYTTF

SEQ ID NO: 100 - protein, 594 aa, Phanerochaete chrysosporium
TVANVSPEWAAAYVKAQAAVAKLSVTDMVNLATGVQWQKGPCVGNTPAISSIPGFTGLCLQDSPVGVRYADGTSVFPPEINVAATWNRTLMRQRGAAMGAEFKGKGVHVALGPMMNLMRVPAAGRNWEGGGGDPFLSGEVAFETITGIQSSGAQACAKHFINNEQEHFRDSSSSNVDDRTEHELYGHPFLRSVQANVASVMCSYNQINGTFSCENEKTLSGLLKGEYGFQGYVMSDWWATHSGAPAVNAGLDMTMPGDETLSSGTTYFGQNLVNAVNSGQVSQARVKDMATRILAAWYLLGQDQNFPAVNFNSWNSGQGQHVNVSGNHASLIRTIGAASQILLKNVNSALPLKKPKTIGIIGNGAGSNPNGPNAFSDRAGDVGVLALGWGSGTANFPYLVAPVDAITARASQDGTTVSSSLSDTDLTGAANTATGKDVAMVFITADSGEGYLTVEGNAGDRNDLQAWHGGDALVQQVASHNKNTIVVINSVGPINMEAWVNHPNVTAIVWSGLPGQEAGNAVTDVLFGAVNPGGKLPFTIGKSISDYSAQIITTGSGIVPIPYNEGLFIDYRHFDQAGIAPRFEFGFGLSYTTF

SEQ ID NO: 101 - protein, 618 aa, Pichia anomala
GKWQAAFYRARELVDQMSIAEKVNLTTGVGSASGPCSGNTGSVPRLNISSICVQDGPLSVRAADLTDVFPCGMAASSSFNKQLIYDRAVAIGSEFKGKGADAILGPVYGPMGVKAAGGRGWEGHGPDPYLEGVIAYLQTIGIQSQGVVSTAKHLIGNEQEHFRFAKKDKHAGKIDPGMFNTSSSLSSEIDDRAMHEIYLWPFAEAVRGGVSSIMCSYNKLNGSHACQNSYLLNYLLKEELGFQGFVMTDWGALYSGIDAANAGLDMDMPCEAQYFGGNLTTAVLNGTLPQDRLDDMATRILSALIYSGVHNPDGPNYNAQTFLTEGHEYFKQQEGDIVVLNKHVDVRSDINRAVALRSAVEGVVLLKNEHETLPLGREKVKRISILGQAAGDDSKGTSCSLRGCGSGAIGTGYGSGAGTFSYFVTPADGIGARAQQEKISYEFIGDSWNQAAAMDSALYADAAIEVANSVAGEEIGDVDGNYGDLNNLTLWHNAVPLIKNISSINNNTIVIVTSGQQIDLEPFIDNENVTAVIYSSYLGQDFGTVLAKVLFGDENPSGKLPFTIAKDVNDYIPVIEKVDVPDPVDKFTESIYVDYRYFDKYNKPVRYEFGYGLSYSNF

SEQ ID NO: 102 - protein, 585 aa, Piromyces sp.
VSQVFATSWSEADEKAKSFMSDLSESEKIDIVTGYMNMQGTCVGNIKPLDRKNFKGLCLQDGPAGVRFNGGTSTTWQAGINNAATFNKDLLYKIGKDQGAEFYAKGINIALAPSMNILRAPASGRVWENFGEDPYLSGVCGAQITKGYQDSGVIVAAKHYVANDIEHNREASSSNMDDQTLMEIHVEPFYRTIKDGDAGSVMASYNAVNNIYVVQNKKVLTEILKEGIGFQGFVMSDWWAIHDLEGSFNAGMDMNMPGGKAWGPDYVNNSFWGSNISNAIRSGQVSSSRLDDAVRRIIRTLYRFDQMSGYPNVNLKAPSMHADTNRQAAIESSVLLKNADDILPLTKKYRKIAIIGKDADKAQSCTDTACSGGNIIQGWGSGTTDFTGISDPITAIKNRASKEGISIVSSISDSANEGANVAKDADVAVVFVRATSGEEYIVVDNNKGDRNNLDLWHGGNDLVKSVAAVNKNTVVVIHAPATVNLPFLNNVKAIIHAGMPGAESGNAIASILFGDSNPSGHLPFTWAAREDYCCDVSYPAELPHGGNSKTAYDYKEGLFVGYRWFDKKNKTPIFPFGHGLSYTTF

SEQ ID NO: 103 - protein, 635 aa, Saccharomycopsis fibuligera
QGGRLQGVWQDAYTKAKALVSQMTIVEKVNLTTGTGWQLGPCVGNTGSVPRFGIPNLCLQDGPLGVRLTDFSTGYPSGMATGATFNKDLFLQRGQALGHEFNSKGVHIALGPAVGPLGVKARGGRNFEAFGSDPYLQGIAAAATIKGLQENNVMACVKHFIGNEQDIYRQPSNSKVDPEYDPATKESISANIPDRAMHELYLWPFADSIRAGVGSVMCSYNRVNNTYSCENSYMINHLLKEELGFQGFVVSDWAAQMSGAYSAISGLDMSMPGELLGGWNTGKSYWGQNLTKAVYNETVPIERLDDMATRILAALYATNSFPTKDRLPNFSSFTTKEYGNEFFVDKTSPVVKVNHFVDPSNDFTEDTALKVAEESIVLLKNEKNTLPISPNKVRKLLLSGIAAGPDPKGYECSDQSCVDGALFEGWGSGSVGYPKYQVTPFEEISANARKNKMQFDYIRESFDLTQVSTVASDAHMSIVVVSAVSGEGYLIIDGNRGDKNNVTLWHNSDNLIKAVAENCANTVVVITSTGQVDVESFADHPNVTAIVWAGPLGDRSGTAIANILFGNANPSGHLPFTVAKSNDDYIPIVTYNPPNGEPEDNTLAEHDLLVDYRYFEEKNIEPRYAFGYGLSYNEY

SEQ ID NO: 104 - protein, 633 aa, Saccharomycopsis fibuligera
QGGRLQDVWQEAYARAKAIVGQMTIVEKVNLTTGTGWQLDPCVGNTGSVPRFGIPNLCLQDGPLGVRFADFVTGYPSGLATGATFNKDLFLQRGQALGHEFNSKGVHIALGPAVGPLGVKARGGRNFEAFGSDPYLQGTAAAATIKGLQENNVMACVKHFIGNEQEKYRQPDDINPATNQTTKEAISANIPDRAMHALYLWPFADSVRAGVGSVMCSYNRVNNTYACENSYMMNHLLKEELGFQGFVVSDWGAQLSGVYSAISGLDMSMPGEVYGGWNTGTSFWGQNLTKAIYNETVPIERLDDMATRILAALYATNSFPTEDHLPNFSSWTTKEYGNKYYADNTTEIVKVNYNVDPSNDFTEDTALKVAEESIVLLKNENNTLPISPEKAKRLLLSGIAAGPDPIGYQCEDQSCTNGALFQGWGSGSVGSPKYQVTPFEEISYLARKNKMQFDYIRESYDLAQVTKVASDAHLSIVVVSAASGEGYITVDGNQGDRKNLTLWNNGDKLIETVAENCANTVVVVTSTGQINFEGFADHPNVTAIVWAGPLGDRSGTAIANILFGKANPSGHLPFTIAKTDDDYIPIETYSPSSGEPEDNHLVENDLLVDYRYFEEKNIEPRYAFGYGLSYNEY

SEQ ID NO: 105 - protein, 711 aa, Schizosaccharomyces pombe
MMEHDVEDLINQLDISEKAMLLSGTDLWHTAAIPRLNIPSIRLSDGPNGIRGTSFFNSSPSACFPCGTALGATFDKKLLFEVGEYLAEEAKAKGVSVVLGPTVNIHRGPLNGRGFESFSEDSTLSGLAASYVILGLQSKNVQACIKHFVCNDMEDERNSVSIDVSQRALREVYLMPFQLACKYSNFKSLMTSYNKVNGEHVSQSRILLDNILRKEWEWKGTIISDWFGTYSLKKAIDAGLDLEMPGKPRFRNVNTIQHLVGSKELSESILDERAKNVLKLVKHSWQNTEAENHCELNNDSSCLREALKKFASQSIVLLKNKKKLLPLSRKGTFAVIGPNAKVCNYSGGGSANLKPYYTVSMYDGIAAKIDGVPEYALGCHNYLNLPNIANLLVNPRTGKHGYVAKFYLEPATSENRTLIDDYDLEDGVVRFYDYCNDKMKDGYFYIDIEGYLIPDEDAVYEFGISVFGTALLFIDDVLLIDNKTKQTPTNHTFEFGTIEERNSIYLKKGRKYNVRVEYGSAATYTLSTNLSPSTGGRYSIGCVKVIDPETEIDYAVRVAKSVDCVILCVGLTAEWETEGEDRKTMTLPSLSDKLVYSILQSNPNTVVVTQSGTPIEMPWISEAHTLLHIWYNGNELGNALANIIFGEQNPCGKLPITFPKKLKDNPAYLSFRSSRGHCVYGEDVFVGYKYYEAVEREVLFPFGYGLSYTTF

SEQ ID NO: 106 - protein, 623 aa, Septoria lycopersici
WKAAFEKAADAVSRLNLTQKVALTTGTTAGLSCNGNIAPIPEINFSGLCLADGPVSVRIADLATVFPAGLTAAATWDRQLIYERARALGSEFRGKGSQVHLGPASGALGRHPLGGRNWESFSPDPYLSGVAMDFSIRGIQEMGVQANRKHFIGNEQETQRSNTFTDDGTEIQAISSNIDDRTMHELYLWPFANAVRSGVASVMCSYNRLNQTYACENSKLMNGILKGELGFQGYVVSDWYATHSGVESVNAGLDMTMPGPLDSPSTALRPPPSYLGGNLTEAVLNGTIPEARVDDMARRILMPYFFLGQDTDFPTVDPSTGFVFARTYNYPDEYLTLGGLDPYNPPPARDVRGNHSDIVRKVAAAGTVLLKNVNNVLPLKEPKSVGIFGNGAADVTEGLTFTGDDSGPWGADIGALSVGGGSGAGRHTHLVSPLAAIRKRTESVGGRVQYLLSNSRIVNDDFTSIYPTPEVCLVFLKTWAREGTDRLSYENDWNSTAVVNNVARRCPNTIVVTHSGGINTMPWADNANVTAILAAHYPGQENGNSIMDILYGDVNPSGRLPYTIPKLATDYDFPVVNITNEAQDPYVWQADFTEGLLIDYRHFDARNITPLYEFGYGLSYTTF

SEQ ID NO: 107 - protein, 621 aa, Talaromyces emersonii
PWANGQGDWAEAYQKAVQFVSQLTLAEKVNLTTGTGWEQDRCVGQVGSIPRLGFPGLCMQDSPLGVRDTDYNSAFPAGVNVAATWDRNLAYRRGVAMGEEHRGKGVDVQLGPVAGPLGRSPDAGRNWEGFAPDPVLTGNMMASTIQGIQDAGVIACAKHFILYEQEHFRQGAQDGYDISDSISANADDKTMHELYLWPFADAVRAGVGSVMCSYNQVNNSYACSNSYTMNKLLKSELGFQGFVMTDWGGHHSGVGSALAGLDMSMPGDIAFDSGTSFWGTNLTVAVLNGSIPEWRVDDMAVRIMSAYYKVGRDRYSVPINFDSWTLDTYGPEHYAVGQGQTKINEHVDVRGNHAEIIHEIGAASAVLLKNKGGLPLTGTERFVGVFGKDAGSNPWGVNGCSDRGCDNGTLAMGWGSGTANFPYLVTPEQAIQREVLSRNGTFTGITDNGALAEMAAAASQADTCLVFANADSGEGYITVDGNEGDRKNLTLWQGADQVIHNVSANCNNTVVVLHTVGPVLIDDWYDHPNVTAILWAGLPGQESGNSLVDVLYGRVNPGKTPFTWGRARDDYGAPLIVKPNNGKGAPQQDFTEGIFIDYRRFDKYNITPIYEFGFGLSYTTF

SEQ ID NO: 108 - protein, 611 aa, Thermoascus aurantiacus
WVSDWAPAYAKAYEVVSNMTLAEKVNMTTGTGIFMGPCVGQTGSALRFGIPNLCLMDSPLGIRNTDHNTAFPAGITVGATFDKELMYARGVALGEEARGKGVNVLMGPMVGPIGRKPRGGRNWEGFGADPTLQAIGGAQTIKGMQSTGVIATLKHFIGNEQEMYRMTSVIQRGYSSNIDDRTLHELYLWPFAEGVRAGVGSVMMAYNDVNGSACSQNSKLINGILKDELGFQGFVMTDWLTQIGGVSSALAGLDMAMPGDGPIPLFGDSYWGSELSRAVLNGTVPVDRLNDMVTRIVATWYKFGQDKDFPLPNFSSNTDAATGLLYPGAVFSPIGVVNQFVDVQGDHKVVARAIARDAITLLKNEDNALPLKRNDSLKIFGTDAGTNPDGINSCADKGCDKGVLTMGWGSGTSKLPYLNTPQEAIANASSNAEFFVTDSFPSNVNANPEDIAIVFINADSGENYITVEGNYGDRSAAGLYAWHNGDDLVKAAAAKFSKVVVVVHTVGPIILENWIDLPSVKSVVFAHLPGQEAGDSLVDVLFGDYSPSGHLPYTIPRSEDQYPSSVSLINQPFGQIQDTFTEGLYIDYRHFLHANLTPRYPFGHGLSYTTF

SEQ ID NO: 109 - protein, 626 aa, Thermoascus aurantiacus
PWMDGNGEWAEAYRRAVDFVSQLTLAEKVNLTTGVGWMQEKCVGETGSIPRLGFRGLCLQDSPLGVRFADYVSAFPAGVNVAATWDKNLAYLRGKAMGEEHRGKGVDVQLGPVAGPLGRHPDGGRNWEGFSPDPVLTGVLMAETIKGIQDAGVIACAKHFIGNEMEHFRQASEAVGYGFDITESVSSNIDDKTLHELYLWPFADAVRAGVGSFMCSYNQVNNSYSCSNSYLLNKLLKSELDFQGFVMSDWGAHHSGVGAALAGLDMSMPGDTAFGTGKSFWGTNLTIAVLNGTVPEWRVDDMAVRIMAAFYKVGRDRYQVPVNFDSWTKDEYGYEHALVGQNYVKVNDKVDVRADHADIIRQIGSASVVLLKNDGGLPLTGYEKFTGVFGEDAGSNRWGADGCSDRGCDNGTLAMGWGSGTADFPYLVTPEQAIQNEILSKGKGLVSAVTDNGALDQMEQVASQASVSIVFVNADSGEGYINVDGNEGDRKNLTLWKGGEEVIKTVAANCNNTIVVMHTVGPVLIDEWYDNPNVTAIVWAGLPGQESGNSLVDVLYGRVSPGGKTPFTWGKTRESYGAPLLTKPNNGKGAPQDDFTEGVFIDYRRFDKYNETPIYEFGFGLSYTTF

SEQ ID NO: 110 - protein, 626 aa, Thermoascus aurantiacus
PWMNGNGEWAEAYRRAVDFVSQLTLAEKVNLTTGVGWMQEKCVGETGSIPRLGFRGLCLQDSPLGVRFADYISAFPAGVNVAATWDKNLAYLRGKAMGEEHRGKGVDVQLGPVAGPLGRHPDGGRNWEGFSPDPVLTGVLMAETIKGIQDAGVIACAKHFIGNEMEHFRQASEAVGYGFDITESVSSNIDDKTLHELYLWPFADAVRAGVGSFMCSYNQVNNSYSCSNSYLLNKLLKSELDFQGFVMSDWGAHHSGVGAALAGLDMSMPGDTAFGTGKSFWGTNLTIAVLNGTVPEWRVDDMAVRIMAAFYKVGRDRYQVPVNFDSWTKDEHGYEHALVGQDYVKVNDKVDVRADHADIIRQIGSASVVLLKNDGGLPLTGYEKFTGVFGEDAGSNRWGADGCSDRGCDNGTLAMGWGSGTADFPYLVTPEQAIQNEILSKGKGLVSAVTDNGALDQMEQVASQASVSIVFVNADSGEGYINVDGNEGDRKNLTLWKGGEEVIKTVAANCNNTIVVMHTVGPVLIDEWYDNPNVTAIVWAGLPGQESGNSLVDVLYGRVSPGGKTPFTWGKTRESYGAPLLTKPNNGKGAPQDDFTEGVFIDYRRFDKYNETPIYEFGFGLSYTTF

SEQ ID NO: 111 - protein, 615 aa, Thermoascus aurantiacus
PPGGWVSDWAPAYAKAYEVVSNMTLAEKVNMTTGTGIFMGPCVGQTGSALRFGIPNLCLMDSPLGIRNTDHNTAFPAGITVGATFDKELMYARGVALGEEARGKGVNVLMGPMVGPIGRKPRGGRNWEGFGADPTLQAIGGAQTIKGMQSTGVIATLKHFIGNEQEMYRMTSVIQRGYSSNIDDRTLHELYLWPFAEGVRAGVGSVMMAYNDVNGSACSQNSKLINGILKDELGFQGFVMTDWLTQIGGVSSALAGLDMAMPGDGPIPLFGDSYWGSELSRAVLNGTVPVDRLNDMVTRIVATWYKFGQDKDFPLPNFSSNTDAATGLLYPGAVFSPIGVVNQFVDVQGDHKVVARAIARDAITLLKNEDNALPLKRNDSLKIFGTDAGTNPDGINSCADKGCDKGVLTMGWGSGTSKLPYLNTPQEAIANASSNAEFFVTDSFPSNVNANPEDIAIVFINADSGENYITVEGNYGDRSAAGLYAWHNGDDLVKAAAAKFSKVVVVVHTVGPIILENWIDLPSVKSVVFAHLPGQEAGDSLVDVLFGDYSPSGHLPYTIPRSEDQYPSSVSLINQPFGQIQDTFIEGLYIDYRHFLHANLTPRYPFGHGLSYTTF

SEQ ID NO: 112 - protein, 577 aa, Trichoderma viride
VVLPAGTPWGTAYDKAKAALAKLNLQDKVGIVSGVGWNGGPCVGNTSPASKFSYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHATVQSANSGLDVSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWTGLPSQESGNALVDVLWGDVSPSGKLVYTIAKSPNDYNTRIVSGGSDSFSEGLFIDYKHFDDANITPRYEFGYGL

SEQ ID NO: 113 - protein, 602 aa, Tropaeolum majus
EYMRYKDPKKPLNVRIKDLMSRMTLAEKIGQMTQIERKEATPDVISKYFIGSVLSGGGSVPAPKASPEAWVDLVNGMQKAALSTRLGIPMIYGIDAVHGHNNVYNATIFPHNVGLGVTRDPALIKRIGEATALECRATGIPYAFAPCIAVCRDPRWGRCYESYSEDHTIVQAMTEIIPGLQGDVPPDVKKGVPFVGGKTKVAACAKHFVGDGGTTKGIDENNTVIDSRGLFSIHMPAYHDSIKKGVATVMVSYSSWNGLRMHANRDLVTGYLKNKLKFRGFVISDWEGIDRITDPPGRNYSYSVEAGVGAGIDMIMVPEDFTKFLNELTSQVKKNIIPMSRIDDAVKRILRVKFVMGLFESPLADYSLANQLGSQEHRDLAREAVRKSLVLLKNGESADKPFVPLPKNAKKILVAGSHADNLGRQCGGWTIEWQGVNGNDLTTGTTILNAIKKTVDPTTQVIYNENPDSNYVKTNSFDYAIVVVGEPPYAEMQGDSFNLTIPEPGPTTISSVCGAVKCVVVVISGRPVVLQPYVSYMDALVAAWLPGTEGQGVTDVLFGDYGFTGKLARTWFKTVDQLPMNVGDKHYDPLFPFGFGLTTKPS

SEQ ID NO: 114 - protein, 621 aa, Uromyces viciae-fabae
PVQSGLSPWSESIVRARAFVAQLTIEEKVNLTTGAGTQGRCVGETGTVPRLGFNQPICLQDGPVGIRYTDFNSVFPAAINVAATFDKQLMFKRAQAMAEEFRGKGANVVLAPMTNLMRTPQAGRAWEGYGSDPYLSGVATVQSVLGIQSTRASACVKHYIGNEQEHYRGGSGATASSSNIDDRTLRELYEWPFAEAIHAGVDYIMCSYNRVNQTYACENSKLINGIAKGEHKFQGVMVTDWAAAESGVRTALAGTDMNMPGFMAYGQPSEPNPSTANGSYWGLRMIEAVKNGTVPMERLDDMVTRVISTYYKQGQDKSDYPKLNFMSMGQGTPAEQAVSNHHVNVQKDHYLIIRQIATASTILLKNVNHTLPLKSPDKMRSVVVVGSDAGDNPQGPNSCVDRGCNRGILAIGWGSGTANFAHLTAPATSIQNYLLQSNPTITYRSIFDDYAYDEIAKAASTADVSIVHVSSDSGEGYLTVEGNQGDRSNTSLWNKGDELILKAAEACNNVVVVIHSVGPVDMEAWINHPNVTAVLLAGLPGQEAGSAEVDVLWGSTNPSGRLPYTIAKKPSDYPAELLYESNMTVPQINYSERLNIDYRHFDTYNIEPRFEFGFGLSYTTF

SEQ ID NO: 115 - protein, 731 aa, Volvariella volvacea
MPPSDFAKANIDEIVEQLTLDEAISLTAGVGFWHTHAIERLGVPAVKVSDGPNGIRGNHFFMGTPAKCLPSSTALGATWDPEVVEEVGLKLLAPEAKLRAASLVLAPTSNIQRNPLGGRSFESFSEDPYLSGIISASYVNGVQKGGIGATIKHFVGNDKEDDRQGYDSIISERALREIYLLPFMLTQKYAAPWAIMTAYNRVNGVHVAEDPFLLKQVLRNEWKYKGLIMSDWFGMYSVDHGIKAGLDLEMPGINKWRTLDLVNRTIQARKLTPRDIKDRARVVLELVKKCAQGAPEILDGDGEERTVELESDKLLMRRIASESIVLLKNDNVLPLKPEGGAIKKIAVVGGNAKAQVLSGGGSAALKASYFISPYDGIKAALEPHGVEVTFSEGARAYKTLPTLEWDLETETGERGWIGTWHTHESDDSMTALDQPFIAPRLVDETRIFISTSYPKGITKRWTMRLKGYLKPREKDTNFEFGLIAAGRAKLWVDGQLVIDNWTRQRRGEAFFGSGSQEETGVYLLKAGKKHEIYVEYCNVRAPADGDEDEAIMDSNPGVRLGGAEVANADDLLSEAVKLASEADAVIAVVGLNADWETEGNDRRTLALPGRTDELVEKVAKVNSKTVVVTQAGSAITLPWLDSVAAVVHAWYLGNATGDAIADVLFGKQNPSGKLSLTFPKRLEDVPSHGHFGSENGKVRYAEDLFVGYKHYHHRNIEPLFPFGFGLSYTTF

SEQ ID NO: 116 - protein, 713 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 117 - protein, 713 aa, Trichoderma reesei
VVPPAGTPWGTAYDKAKAALAKLNLQDKVGIVSGVGWNGGPCIGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 118 - protein, 713 aa, Trichoderma reesei
VVPPAGTPWGTAYDKAKAALAKLNLQDKVGIVSGVGWNGGPCCGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 119 - protein, 713 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEAKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 120 - protein, 713 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEGKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 121 - protein, 713 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDINGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 122 - protein, 713 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDVNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 123 - protein, 713 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDQNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 124 - protein, 713 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDDNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 125 - protein, 713 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRNVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 126 - protein, 713 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRWVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 127 - protein, 713 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRAVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 128 - protein, 713 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRSVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 129 - protein, 713 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRGVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 130 - protein, 713 aa, Trichoderma reesei
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRLVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 131 - protein, 713 aa, Trichoderma reesei
VVPPAGTPWGTAYDKAKAALAKLNLQDKVGIVSGVGWNGGPCVGNTSPASKISYPSLCLQDGPLGVRYSTGNTAFTPGVQAASTWDVNLIRERGQFIGEEMKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDINGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 132 - protein, 713 aa, Trichoderma reesei
VVPPAGTPWGTAYDKAKAALAKLNLQDKVGIVSGVGWNGGPCIGNTSPASKISYPSLCLQDGPLGVRYSTGNTAFTPGVQAASTWDVNLIRERGQFIGEEMKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 133 - protein, 713 aa, Trichoderma reesei
VVPPAGTPWGTAYDKAKAALAKLNLQDKVGIVSGVGWNGGPCVGNTSPASKISYPSLCLQDGPLGVRYSTGNTAFTPGVQAASTWDVNLIRERGQFIGEEMKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRNVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 134 - protein, 713 aa, Trichoderma reesei
VVPPAGTPWGTAYDKAKAALAKLNLQDKVGIVSGVGWNGGPCVGNTSPASKISYPSLCLQDGPLGVRYSTGNTAFTPGVQAASTWDVNLIRERGQFIGEEMKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRDVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 135 - protein, 713 aa, Trichoderma reesei
VVPPAGTPWGTAYDKAKAALAKLNLQDKVGIVSGVGWNGGPCVGNTSPASKISYPSLCLQDGPLGVRYSTGNTAFTPGVQAASTWDVNLIRERGQFIGEEMKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRLVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 136 - protein, 713 aa, Trichoderma reesei
VVPPAGTPWGTAYDKAKAALAKLNLQDKVGIVSGVGWNGGPCIGNTSPASKISYPSLCLQDGPLGVRYSTGNTAFTPGVQAASTWDVNLIRERGQFIGEEMKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDINGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 137 - protein, 713 aa, Trichoderma reesei
VVPPAGTPWGTAYDKAKAALAKLNLQDKVGIVSGVGWNGGPCIGNTSPASKISYPSLCLQDGPLGVRYSTGNTAFTPGVQAASTWDVNLIRERGQFIGEEMKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDINGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRNVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 138 - protein, 713 aa, Trichoderma reesei
VVPPAGTPWGTAYDKAKAALAKLNLQDKVGIVSGVGWNGGPCIGNTSPASKISYPSLCLQDGPLGVRYSTGNTAFTPGVQAASTWDVNLIRERGQFIGEEMKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRNVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 139 - protein, 713 aa, Trichoderma reesei
VVPPAGTPWGTAYDKAKAALAKLNLQDKVGIVSGVGWNGGPCVGNTSPASKISYPSLCLQDGPLGVRYSTGNTAFTPGVQAASTWDVNLIRERGQFIGEEMKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDINGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRNVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 140 - protein, 713 aa, Trichoderma reesei
VVPPAGTPWGTAYDKAKAALAKLNLQDKVGIVSGVGWNGGPCVGNTSPASKISYPSLCLQDGPLGVRYSTGNTAFTPGVQAASTWDVNLIRERGQFIGEEMKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDINGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRLVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 141 - protein, 829 aa, Aspergillus aculeatus
PWANGQGEWAEAYQRAVAIVSQMTLDEKVNLTTGTGWELEKCVGQTGGVPRLNIGGMCLQDSPLGIRDSDYNSAFPAGVNVAATWDKNLAYLRGQAMGQEFSDKGIDVQLGPAAGPLGRSPDGGRNWEGFSPDPALTGVLFAETIKGIQDAGVVATAKHYILNEQEHFRQVAEAAGYGFNISDTISSNVDDKTIHEMYLWPFADAVRAGVGAIMCSYNQINNSYGCQNSYTLNKLLKAELGFQGFVMSDWGAHHSGVGSALAGLDMSMPGDITFDSATSFWGTNLTIAVLNGTVPQWRVDDMAVRIMAAYYKVGRDRLYQPPNFSSWTRDEYGFKYFYPQEGPYEKVNHFVNVQRNHSEVIRKLGADSTVLLKNNNALPLTGKERKVAILGEDAGSNSYGANGCSDRGCDNGTLAMAWGSGTAEFPYLVTPEQAIQAEVLKHKGSVYAITDNWALSQVETLAKQASVSLVFVNSDAGEGYISVDGNEGDRNNLTLWKNGDNLIKAAANNCNNTIVVIHSVGPVLVDEWYDHPNVTAILWAGLPGQESGNSLADVLYGRVNPGAKSPFTWGKTREAYGDYLVRELNNGNGAPQDDFSEGVFIDYRGFDKRNETPIYEFGHGLSYTTFNYSGLHIQVLNASSNAQVATETGAAPTFGQVGNASDYVYPEGLTRISKFIYPWLNSTDLKASSGDPYYGVDTAEHVPEGATDGSPQPVLPAGGGSGGNPRLYDELIRVSVTVKNTGRVAGDAVPQLYVSLGGPNEPKVVLRKFDRLTLKPSEETVWTTTLTRRDLSNWDVAAQDWVITSYPKKVHVGSSSRQLPLHAALPKVQ

SEQ ID NO: 142 - protein, 718 aa, Aspergillus fumigatus
GSWAAAYAKAKKFVAQLTPEEKVNLTAGTDANNGCSGNIAAIPRLNFPGLCVSDAGNGLRGTDYVSSWPSGLHVGASWNKALARQRAVQMATEFRKKGVNVLLGPVVGPLGRVAEAGRNWEGFSNDPYLSGALVYETVDGAQSVGVATCTKHYILNEQETNRNPGMEDGVEVAAVSSNIDDKTMHELYLWPFQDAVLAGSASIMCSYNRVNNSYGCQNSKTLNGLLKTELGFQGYVMTDWGAQHAGIAGANAGLDMVMPSTETWGANLTTAISNGTMDASRLDDMATRIIASWYQMNQDSDFPSPGAGMPSDMYAPHQRVIGRDASSKQTLLRGAIEGHVLVKNNHSALPLKSPQLLSVFGYDAKGPNALKQNFNWLSYSPAIQENHTLWVGGGSGANNAAYIDAPIDAIQRQAYEDGTSVLYDISSEDPEVDPTTDACLVFINSYATEGWDRPGLADNSSDTLVKNVARKCANTIVTIHNAGIRVVGEWIDHENVTAVIFAHLPGQDSGRALVELLYGRANPSGKLPYTVAKKVEDYGSLLHPSLPETPYGLFPQSDFDEGVYIDYRAFDRANITAQFEFGFGLSYTSFDYSGLQISNPKQSPQYPPSAAIQQGGNPHLWDNIVTVSAEIKNTGRVAGAEVAQLYIGIPNGPVRQLRGFEKVDVSAGETTQVQFALNRRDLSTWDVEAQQWSLQRGTYRVYVGRSSRDLPLTGSFTL

SEQ ID NO: 143 - protein, 832 aa, Aspergillus fumigatus
PWADGQGEWADAHRRAVEIVSQMTLAEKVNLTTGTGWEMDRCVGQTGSVPRLGINWGLCGQDSPLGIRFSDLNSAFPAGTNVAATWDKTLAYLRGKAMGEEFNDKGVDILLGPAAGPLGKYPDGGRIWEGFSPDPALTGVLFAETIKGIQDAGVIATAKHYILNEQEHFRQVGEAQGYGYNITETISSNVDDKTMHELYLWPFADAVRAGVGAVMCSYNQINNSYGCQNSQTLNKLLKAELGFQGFVMSDWSAHHSGVGAALAGLDMSMPGDISFDDGLSFWGTNLTVSVLNGTVPAWRVDDMAVRIMTAYYKVGRDRLRIPPNFSSWTRDEYGWEHSAVSEGAWTKVNDFVNVQRSHSQIIREIGAASTVLLKNTGALPLTGKEVKVGVLGEDAGSNPWGANGCPDRGCDNGTLAMAWGSGTANFPYLVTPEQAIQREVISNGGNVFAVTDNGALSQMADVASQSSVSLVFVNADSGEGFISVDGNEGDRKNLTLWKNGEAVIDTVVSHCNNTIVVIHSVGPVLIDRWYDNPNVTAIIWAGLPGQESGNSLVDVLYGRVNPSAKTPFTWGKTRESYGAPLLTEPNNGNGAPQDDFNEGVFIDYRHFDKRNETPIYEFGHGLSYTTFGYSHLRVQALNSSSSAYVPTSGETKPAPTYGEIGSAADYLYPEGLKRITKFIYPWLNSTDLEDSSDDPNYGWQDSEYIPEGARDGSPQPLLKAGGAPGGNPTLYQDLVRVSATITNTGNVAGYEVPQLYVSLGGPNEPRVVLRKFDRIFLAPGEQKVWTTTLNRRDLANWDVEAQDWVITKYPKKVHVGSSSRKLPLRAPLPRVY

SEQ ID NO: 144 - protein, 829 aa, Aspergillus kawachii
PWANGQGDWAQAYQRAVDIVSQMTLAEKVNLTTGTGWELELCVGQTGGVPRLGVPGMCLQDSPLGVRDSDYNSAFPSGMNVAATWDKNLAYLRGKAMGQEFSDKGADIQLGPAAGPLGRSPDGGRNWEGFSPDPALSGVLFAETIKGIQDAGVVATAKHYIAYEQEHFRQAPEAQGYGFNISESGSANLDDKTMHELYLWPFADAIRAGAGAVMCSYNQINNSYGCQNSYTLNKLLKAELGFQGFVMSDWAAHHAGVSGALAGLDMSMPGDVDYDSGTSYWGTNLTVSVLNGTVPQWRVDDMAVRIMAAYYKVGRDRLWTPPNFSSWTRDEYGYKYYYVSEGPYEKVNHYVNVQRNHSELIRRIGADSTVLLKNDGALPLTGKERLVALIGEDAGSNPYGANGCSDRGCDNGTLAMGWGSGTANFPYLVTPEQAISNEVLKNKNGVFTATDNWAIDQIEALAKTASVSLVFVNADSGEGYINVDGNLGDRKNLTLWRNGDNVIKAAASNCNNTIVIIHSVGPVLVNEWYDNPNVTAILWGGLPGQESGNSLADVLYGRVNPGAKSPFTWGKTREAYQDYLVTEPNNGNGAPQEDFVEGVFIDYRGFDKRNETPIYEFGYGLSYTTFNYSNLEVQVLSAPAYEPASGETEAAPTFGEVGNASNYLYPDGLQKITKFIYPWLNSTDLEASSGDASYGQDSSDYLPEGATDGSAQPILPAGGGPGGNPRLYDELIRVSVTIKNTGKVAGDEVPQLYVSLGGPNEPKIVLRQFERITLQPSEETKWSTTLTRRDLANWNVEKQDWEITSYPKMVFVGSSSRKPPLRASLPTVH

SEQ ID NO: 145 - protein, 837 aa, Aspergillus nidulans
AQIESVLSKLTLEEKISLLAGKNFWETQDYPEKGVPPVKTSDGPNGARGATFKGGVTAACFPASSLLAATWDLDAAKHIGEALADETRSKGARVLLAPTVCIHRHPLGGRNFESFSEDPFLAGKLAAQYIKGLQGNGVAATIKHYAANEQETCRFTVNEHITERALREIYLKPFEIAIKESNPLAVMTAYNIVNGTHADSNNFLLRDVLRGEWGWKGLVMSDWGGTNSTADALNAGLDLEMPGPTRWRKVDEVLAVVKSGAVLEETIDERARNVLELLAKLNCFENPTIPEEKAINRPEHQKLIRSVGSQGLVLLKNEGDVLPLRKEILTNKKVALLGFAREALIHGGGSASVNAHYRVTPEEGLRAALGDTVEFEYAKGAHTFRQLPLMSDNVVNLEGQPGWTLDFFADEEPNGEPGSSISSEQPSYIPLFVKESWGSVRASAHFTPTQSGKHYFGMSGLGRSKLLIDGEVIYEQKLNCPDSMGFLLGGVEEPEIQYSFEAGKTYAVEVVSVKPTSKGGLALLDGFIGFRLGFMTEEEHNRDLLSEAVDVAKRSDIAIVFTGHTPDWETEGQDQISFHLPSNGSQDRLVAAVGAANPNTVVVNCTGVAVAMPWLDKVKAVVQAWFPGQEAGNAIADVLTGAVNPSGRLPVSFPRAIEDAPAHGNFPGDYTDGKDNRRHLEVTYKEGVFVGYRHYDLSEANRAKVLFPFGYGLSYTTFTHANHKASATSRNTVEVAVDVTNVGTCAGADVVQVYAGAKLAVPENPVKELVGFAKVHLKPGETKTANITFEVRQLTHFTERSGKWELESGDYEISIGQSVRDITGKVEIGLEAQNYKP

SEQ ID NO: 146 - protein, 829 aa, Aspergillus niger
PWANGQGDWAQAYQRAVDIVSQMTLDEKVNLTTGTGWELELCVGQTGGVPRLGVPGMCLQDSPLGVRDSDYNSAFPAGMNVAATWDKNLAYLRGKAMGQEFSDKGADIQLGPAAGPLGRSPDGGRNWEGFSPDPALSGVLFAETIKGIQDAGVVATAKHYIAYEQEHFRQAPEAQGFGFNISESGSANLDDKTMHELYLWPFADAIRAGAGAVMCSYNQINNSYGCQNSYTLNKLLKAELGFQGFVMSDWAAHHAGVSGALAGLDMSMPGDVDYDSGTSYWGTNLTISVLNGTVPQWRVDDMAVRIMAAYYKVGRDRLWTPPNFSSWTRDEYGYKYYYVSEGPYEKVNQYVNVQRNHSELIRRIGADSTVLLKNDGALPLTGKERLVALIGEDAGSNPYGANGCSDRGCDNGTLAMGWGSGTANFPYLVTPEQAISNEVLKHKNGVFTATDNWAIDQIEALAKTASVSLVFVNADSGEGYINVDGNLGDRRNLTLWRNGDNVIKAAASNCNNTIVVIHSVGPVLVNEWYDNPNVTAILWGGLPGQESGNSLADVLYGRVNPGAKSPFTWGKTREAYQDYLVTEPNNGNGAPQEDFVEGVFIDYRGFDKRNETPIYEFGYGLSYTTFNYSNLEVQVLSAPAYEPASGETEAAPTFGEVGNASDYLYPSGLQRITKFIYPWLNGTDLEASSGDASYGQDSSDYLPEGATDGSAQPILPAGGGPGGNPRLYDELIRVSVTIKNTGKVAGDEVPQLYVSLGGPNEPKIVLRQFERITLQPSEETKWSTTLTRRDLANWNVEKQDWEITSYPKMVFVGSSSRKLPLRASLPTVH

SEQ ID NO: 147 - protein, 829 aa, Aspergillus niger
PWANGQGDWAEAYQRAVDIVSQMTLAEKVNLTTGTGWELELCVGQTGGVPRLGIPGMCAQDSPLGVRDSDYNSAFPAGVNVAATWDKNLAYLRGQAMGQEFSDKGADIQLGPAAGPLGRSPDGGRNWEGFSPDPALSGVLFAETIKGIQDAGVVATAKHYIAYEQEHFRQAPEAQGYGFNITESGSANLDDKTMHELYLWPFADAIRAGAGAVMCSYNQINNSYGCQNSYTLNKLLKAELGFQGFVMSDWAAHHAGVSGALAGLDMSMPGDVDYDSGTSYWGTNLTISVLNGTVPQWRVDDMAVRIMAAYYKVGRDRLWTPPNFSSWTRDEYGFKYYYVSEGPYEKVNQFVNVQRNHSELIRRIGADSTVLLKNDGALPLTGKERLVALIGEDAGSNPYGANGCSDRGCDNGTLAMGWGSGTANFPYLVTPEQAISNEVLKNKNGVFTATDNWAIDQIEALAKTASVSLVFVNADSGEGYINVDGNLGDRRNLTLWRNGDNVIKAAASNCNNTIVIIHSVGPVLVNEWYDNPNVTAILWGGLPGQESGNSLADVLYGRVNPGAKSPFTWGKTREAYQDYLYTEPNNGNGAPQEDFVEGVFIDYRGFDKRNETPIYEFGYGLSYTTFNYSNLQVEVLSAPAYEPASGETEAAPTFGEVGNASDYLYPDGLQRITKFIYPWLNSTDLEASSGDASYGQDASDYLPEGATDGSAQPILPAGGGAGGNPRLYDELIRVSVTIKNTGKVAGDEVPQLYVSLGGPNEPKIVLRQFERITLQPSKETQWSTTLTRRDLANWNVETQDWEITSYPKMVFAGSSSRKLPLRASLPTVH

SEQ ID NO: 148 - protein, 829 aa, Aspergillus oryzae
PWADGQGEWAEVYKRAVDIVSQMTLTEKVNLTTGTGWQLERCVGQTGSVPRLNIPSLCLQDSPLGIRFSDYNSAFPAGVNVAATWDKTLAYLRGQAMGEEFSDKGIDVQLGPAAGPLGAHPDGGRNWEGFSPDPALTGVLFAETIKGIQDAGVIATAKHYIMNEQEHFRQQPEAAGYGFNVSDSLSSNVDDKTMHELYLWPFADAVRAGVGAVMCSYNQINNSYGCENSETLNKLLKAELGFQGFVMSDWTAHHSGVGAALAGLDMSMPGDVTFDSGTSFWGANLTVGVLNGTIPQWRVDDMAVRIMAAYYKVGRDTKYTPPNFSSWTRDEYGFAHNHVSEGAYERVNEFVDVQRDHADLIRRIGAQSTVLLKNKGALPLSRKEKLVALLGEDAGSNSWGANGCDDRGCDNGTLAMAWGSGTANFPYLVTPEQAIQNEVLQGRGNVFAVTDSWALDKIAAAARQASVSLVFVNSDSGESYLSVDGNEGDRNNITLWKNGDNVVKTAANNCNNTVVIIHSVGPVLIDEWYDHPNVTGILWAGLPGQESGNSIADVLYGRVNPGAKSPFTWGKTRESYGSPLVKDANNGNGAPQSDFTQGVFIDYRHFDKFNETPIYEFGYGLSYTTFELSDLHVQPLNASRYTPTSGMTEAAKNFGEIGDASEYVYPEGLERIHEFIYPWINSTDLKASSDDSNYGWEDSKYIPEGATDGSAQPRLPASGGAGGNPGLYEDLFRVSVKVKNTGNVAGDEVPQLYVSLGGPNEPKVVLRKFERIHLAPSQEAVWTTTLTRRDLANWDVSAQDWTVTPYPKTIYVGNSSRKLPLQASLPKAQ

SEQ ID NO: 149 - protein, 829 aa, Aspergillus oryzae
PWADGQGEWAEVYKRAVDIVSQMTLTEKVNLTTGTGWQLERCVGQTGSVPRLNIPSLCLQDSPLGIRFSDYNSAFPAGVNVAATWDKTLAYLRGQAMGEEFSDKGIDVQLGPAAGPLGAHPDGGRNWEGFSPDPALTGVLFAETIKGIQDAGVIATAKHYIMNEQEHFRQQPEAAGYGFNVSDSLSSNVDDKTMHELYLWPFADAVRAGVGAVMCSYNQINNSYGCENSETLNKLLKAELGFQGFVMSDWTAHHSGVGAALAGLDMSMPGDVTFDSGTSFWGANLTVGVLNGTIPQWRVDDMAVRIMAAYYKVGRDTKYTPPNFSSWTRDEYGFAHNHVSEGAYERVNEFVDVQRDHADLIRRIGAQSTVLLKNKGALPLSRKEKLVALLGEDAGSNSWGANGCDDRGCDNGTLAMAWGSGTANFPYLVTPEQAIQNEVLQGRGNVFAVTDSWALDKIAAAARQASVSLVFVNSDSGEGYLSVDGNEGDRNNITLWKNGDNVVKTAANNCNNTVVIIHSVGPVLIDEWYDHPNVTGILWAGLPGQESGNSIADVLYGRVNPGAKSPFTWGKTRESYGSPLVKDANNGNGAPQSDFTQGVFIDYRHFDKFNETPIYEFGYGLSYTTFELSDLHVQPLNASRYTPTSGMTEAAKNFGEIGDASEYVYPEGLERIHEFIYPWINSTDLKASSDDSNYGWEDSKYIPEGATDGSAQPRLPASGGAGGNPGLYEDLFRVSVKVKNTGNVAGDEVPQLYVSLGGPNEPKVVLRKFERIHLAPSQEAVWTTTLTRRDLANWDVSAQDWTVTPYPKTIYVGNSSRKLPLQASLPKAQ

SEQ ID NO: 150 - protein, 823 aa, Aspergillus oryzae
PNGGWISEWASAYEKAHRVVSNMTLAEKVNLTSGTGIYMGPCAGQTGSVPRFGIPNLCLHDSPLGVRNSDHNTAFPAGITVGATFDKDLMYERGVGLGEEARGKGINVLLGPSVGPIGRKPRGGRNWEGFGADPSLQAFGGSLTIKGMQSTGAIASLKHLIGNEQEQHRMSSVITQGYSSNIDDRTLHELYLWPFAESVRAGAGSVMIAYNDVNRSACSQNSKLINGILKDELGFQGFVVTDWLAHIGGVSSALAGLDMSMPGDGAIPLLGTSYWSWELSRSVLNGSVPVERLNDMVTRIVATWYKMGQDKDYPLPNFSSNTEDETGPLYPGALFSPSGIVNQYVNVQGNHNVTARAIARDAITLLKNNENVLPLKRNDTLKIFGTDAGTNSDGINSCTDKGCNKGVLTMGWGSGTSRLPYLITPQEAIANISSNAEFHITDTFPLGVTAGPDDIAIVFINSDSGENYITVDGNPGDRTLAGLHAWHNGDNLVKAAAEKFSNVVVVVHTVGPILMEEWIDLDSVKAVLVAHLPGQEAGWSLTDILFGDYSPSGHLPYTIPHSESDYPESVGLIAQPFGQIQDDYTEGLYIDYRHFLKANITPRYPFGHGLSYTTFNFTEPNLSIIKALDTAYPAARPPKGSTPTYPTAKPDASEVAWPKNFNRIWRYLYPYLDNPEGAAANSSKTYPYPDGYTTEPKPAPRAGGAEGGNPALWDVTFSVQVKVTNTGSRDGRAVAQLYVELPSSLGLDTPSRQLRQFEKTKILAAGESEVLTLDVTRKDLSVWDVVVQDWKAPVNGEGVKIWVGESVADLRVGCVVGEGCSTL

SEQ ID NO: 151 - protein, 761 aa, Aspergillus oryzae
PETKGLGDWEEAFTKARSLVAQMTDKEKNNITYGYSSTANGCGGTSGGVPRLGFPGICLQDAGNGVRGTDMVNSYASGVHVGASWNRDLTYSRAQYMGAEFKRKGVNVALGPVAGPIGRIARGGRNWEGFSNDPYLSGALTGDTVRGLQESVIACVKHLIGNEQETHRSTPSMLANSRNQSSSSNLDDKTMHELYLWPFQDAVKAGAGSVMCSYNRINNSYGCQNSKAMNGLLKGELGFQGFVVSDWGAQHTGIASAAAGLDMAMPSSSYWENGTLALAVKNESLPSTRLDDMATRIVATWYKYAEIENPGHGLPYSLLAPHNLTDARDPKSKSTILQGAVEGHVLVKNTNNALPLKKPQFLSLFGYDAVAAARNTMDDLDWNMWSMGYDNSLTYPNGSAVDAMMLKYIFLSSANPSAFGPGVALNATTITGGGSGASTASYIDAPFNAFQRQAYDDDTFLAWDFASQNPLVNPASDACIVFINEQSSEGWDRPYLADPYSDTLVQNVASQCSNTMVVIHNAGVRLVDRWIENDNITAVIYAHLPGQDSGRALVEVMYGKQSPSGRLPYTVAKNESDYGSLLNPVIQSGTDDIYYPQDNFTEGVYIDYKAFVAANITPRYEFGYGLTYSTFDYSDLKVSTSSNVSTSYLAPGTTVAEGGLPSVWDIIATVTCTVSNTGSVAAAEVAQLYIGIPGGPAKVLRGFEKQLIEPGQQVQVTFDLTRRDLSTWDTEKQNWGLQAGSYALYVGKSVLDIQLTGSLSL

SEQ ID NO: 152 - protein, 773 aa, Botryotinia fuckeliana
RASTSFQNWTHAHHLALTFVNQLNITEKSNIVTGTYHTSTLDGKPMNCIGNIGPIPRLNFTGICLNDGPALLLVRDLISVFPSGVTLAATWDRELVYQSYKALGEEFRGKGTHVALGPVAGPLGRHPLGGRNWEGFSPDPYLTGHLMTASITGMQSVGVQTSSKHFIGNEQETQRSNSPLPDGTNIDAISSNIDDRTLHELYLWPFADAVRAGTTSILCSYNRINETYACENPHLLNNILKGELGFQGYVVSDWFATHSGYPAANAGLDMDMPGYISQSAINTGETYFGPHLISAIQAGNMTEDRLDDMVTRIMTSYFLLNQSSNYPTPDPSQTYVMANMYGYDYGAQIPARDVRANHSSLIRQIGSAGTVLLKNTNNILPLSKPLNIGVFGNSAPDPTDGLTWPQSDLQTGFDIGTLDIGGGSGSARHTTLISPLTALRTRAATYARVQYLTNNALLSSSSSSSFAGIYPIPEICLVFLKTFSSEGVDRTSYPLDWNSTLVVNNVASFCQGNTIVITHSSGINTLPFAQNPNVSAILLAHYPGQESGNSIVDVLFGVVNPSGKLPYTIPVHESDMHIPVVNLSTSEVLAHHQSQNAWQSNFTEKLAIDYRGFEMKNVTPLYEFGHGLSYTTFNLTTPTPSIKHVTTQPITARPNPLSPILPGGNADLYTPLFTLTTRVKNTGTRTGATILQLYISLPETSTPEGTPKKVLRGFEKVEMRGGEERDVEFVLQRRDVSYWDTVLGDWVVPEGDIGVMVGFSVQDLRARVGVVVR

SEQ ID NO: 153 - protein, 827 aa, Coccidioides posadasii
PWASGQGEWSEAYNKAREFVSQLTLTEKVNLTTGVGWMQEACVGNVGSIPRLGFRSLCMQDGPLGIRFADHVSAFPAGINVGATWSKSLAYLRGKAMGEEHRDKGVDVQLGPAVGPLGRSPDGGRNWEGFSPDPVLSGYLVAETIKGIQDAGVIACVKHFIVNEQERFRQAPEAQGYGFNISESSSSNVDDVTMHELYLWPFADAVRAGVGSVMCSYNQINNSYGCSNSYTQNKLLKGELGFQGFIMSDWQAHHSGVGDDLAGLDMSMPGDTLFLTGKSYWGPNLTIAVTNGTIPQWRLDDMAVRIMAAYYKVRRDQTQVPINFNSWTRDEFGYLHAGGQEGYGRVNQMVNVRGRHAVIARKVASASTVLLKNRGVLPLKGKEKLTAVIGEDAGPNLWGPNGCPDRGCANGTLAMGWGSGTADFPYLVTPAQAIENEVITKGVGEAMSVFDNYATSQIESVVSQATVSLVFVNAGAGEGFISVDGNEGDRKNLTLWKNGDELIKTVASMCNNTVVVMHTAGPVLVNKWYDHPNVTAILWAGLPGQESGNALGDVIYGRVNPGAKSPFTWAATSEDYGVSILKEPNAATKAPQIDFEEGIFIDYRAFDKSNTKPIYEFGFGLSYTTFTFSDLEVQPLRANPYVPTSGFTDSAPVFGNSTDHLQFPAGFDPVHLYIYPWLNSTDLKESSMDRDYGLPTEKYVPPGATDGGPQALLPAGGGPGGNPGLYEELYRVSVTITNTGSVTGDEVPQLYLSLGGPNDAKIVLRGFDRVTLRPGENTVWQTTLTRRDISNWDPVTQNWVVTSHPKMIYVGNSSRNQPLSAPLAPSS

SEQ ID NO: 154 - protein, 812 aa, Coccidioides posadasii
EAYSKAHTVVSKMTLAGKVNLTTGTGFLMALVGQTGSALRFGIPRLCLQDGPLGLRNTDHNTAFPAGISVGATFDKKLMYERGCAMGEEFRGKGANVHLGPSVGPLGRKPRGGRNWEGFGSDPSLQAIAAVETIKGVQSKGVIATIKHLVGNEQEMYRMTNIVQRAYSANIDDRTMHELYLWPFAESVRAGVGAVMMAYNDVNGSASCQNSKLINGILKDELGFQGFVMTDWYAQIGGVSSALAGLDMSMPGDGSVPLSGTSFWASELSRSILNGTVALDRLNDMVTRIVATWFKFGQDKDFPLPNFSSYTQNAKGLLYPGALFSPLGVVNQFVNVQADHHKLARVIARESITLLKNEDNLLPLDPNRAIKYSEQMPGTNPRGINACPDKGCNKGVLTMGWGSGTSNLPYLVTPEDAIRNISKNTEFHITDKFPNNVQPGPDDVAIVFVNADSGENYIIVESNPGDRTVAQMKLWHNGDELIESAAKKFSNVVVVVVHTVGPIIMEKWIDLLRSRVSCLPDFQDKKLEILLLISCSETSVRVAASIYDTESRIGLSDSVSLINQRFGQIQDTFTEGLFIDYRHFQKENITPRYHFGYGLSYTTFNFTEPRLESVTTLSEYPPARKPKAGDRHTPTISHLLQKWPGPKTLTGSGAYLYPYLDNPSAIKPKPGYPYPEAIQPNLNLNPRAGGSEAVTRRYGMLRSRFPLKLLILERNPVRAVAQLYVELPTDDEHPTPKLQLRQFEKTATLEPGQSEVLKMEITRKDVSIWDTMVQDWKVPATGKGIKLWIGASVGDLKAVCETGKGKSCHVLN

SEQ ID NO: 155 - protein, 764 aa, Dictyostelium discoideum
SQIYPKKQLNQENINFMSARDTFVDNLMSKMSITEKIGQMTQLDITTLTSPNTITINETTLAYYAKTYYIGSYLNSPVSGGLAGDIHHINSSVWLDMINTIQTIVIEGSPNKIPMIYGLDSVHGANYVHKATLFPHNTGLAATFNIEHATTAAQITSKDTVAVGIPWVFAPVLGIGVQPLWSRIYETFGEDPYVASMMGAAAVRGFQGGNNSFDGPINAPSAVCTAKHYFGYSNPTSGKDRTAAWIPERMLRRYFLPSFAEAITGAGAGTIMINSGEVNGVPMHTSYKYLTEVLRGELQFEGVAVTDWQDIEKLVYFHHTAGSAEEAILQALDAGIICLCHDLLSQLFSLEILAAGTVPESRLDLSVRRILNLKYALGLFSNPYPNPNAAIVDTIGQVQDREAAAATAEESITLLLFKNNILPLNTNTIKNVLLTGPSADSIRNLNGGWSVHWQGAYEDSEFPFGTSILTGLREITNDTADFNIQYTIGHEIGVPTNQTSIDEAVELAQSSDVVVVVIGELPEAETPGDIYDLSMDPNEVLLLQQLVDTGKPVVLILVEARPRILPPDLVYSCAAVLMAYLPGSEGGKPIANILMGNVNPSGRLPLTYPGTTGDIGVPYYHKYSENGVTTPLFQFGDGLSYTTFNYTNLACSNCKPISGQSGNYTGLGQSYTFTVTVTVTNNGNVQGKDSVLLYLSDLWAQVTPEVKMLRGFQKVDLMPAKSQQISFTLNAYEFSFIGVDNKITLESGPFIIMVGNQQLGLYLQ

SEQ ID NO: 156 - protein, 602 aa, Hordeum vulgare
DYLKYKDPKQPLGVRIKDLLGRMTLAEKIGQMTQIERENATAEAMSKYFIGSVLSGGGSVPSPQASAAAWQSMVNEMQKGALSTRLGIPMIYGIDAVHGHNNVYKATIFPHNVGLGATRDPMLVKRIGEATALEVRATGIPYAFAPCIAVCRDPRWGRCYESYSEDPKVVQSMTTLISGLQGDVPAGSEGRPYVGGSKKVAACAKHYVGDGGTFMGINENDTIIDAHGLMTIHMPAYYNSIIRGVSTVMTSYSSWNGKKMHANHFLVTDFLKNKLKFRGFVISDWQGIDRITSPPGVNYSYSVEAGVGAGIDMIMVPFAYTEFIDDLTYQVKNNIIPMSRINDAVYRILRVKFTMGLFESPYADPSLVGELGKQEHRDLAREAVRKSLVLLKNGKSASTPLLPLPKKAGKILVAGSHADDLGNQCGGWTITWQGQTGNDKTAGTTILSAIKSTVDPSTEVVFSENPDSAAVDSGKYDYAIVVVGEPPYAETFGDNLNLTIPAPGPSVIQNVCKSVRCVVVLISGRPLVVEPYISAMDAFVAAWLPGSEGQGVADVLFGDYGFSGKLARTWFKSADQLPMNVGDKHYDPLFPFGFGLTTEAKK

SEQ ID NO: 157 - protein, 828 aa, Hypocrea jecorina
VEAILKKLTLAEKVDLLAGIDFWHTKALPKHGVPSLRFTDGPNGVRGTKFFNGVPAACFPCGTSLGSTFNQTLLEEAGKMMGKEAIAKSAHVILGPTINMQRSPLGGRGFESIGEDPFLAGLGAAALIRGIQSTGVQATIKHFLCNDQEDRRMMVQSIVTERALREIYALPFQIAVRDSQPGAFMTAYNGINGVSCSENPKYLDGMLRKEWGWDGLIMSDWYGTYSTTEAVVAGLDLEMPGPPRFRGETLKFNVSNGKPFIHVIDQRAREVLQFVKKCAASGVTENGPETTVNNTPETAALLRKVGNEGIVLLKNENNVLPLSKKKKTLIVGPNAKQATYHGGGSAALRAYYAVTPFDGLSKQLETPPSYTVGAYTTVPPILGEQCLTPDGAPGMRWRVFNEPPGTPNRQHIDELFFTKTDMHLVDYYHPKAADTWYADMEGTYTADEDCTYELGLVVCGTAKAYVDDQLVVDNATKQVPGDAFFGSATREETGRINLVKGNTYKFKIEFGSAPTYTLKGDTIVPGHGSLRVGGCKVIDDQAEIEKSVALAKEHDQVIICAGLNADWETEGADRASMKLPGVLDQLIADVAAANPNTVVVMQTGTPEEMPWLDATPAVIQAWYGGNETGNSIADVVFGDYNPSGKLSLSFPKRLQDNPAFLNFRTEAGRTLYGEDVYVGYRYYEFADKDVNFPFGHGLSYTTFAFSNLSVSHKDGKLSVSLSVKNTGSVPGAQVAQLYVKPLQAAKINRPVKELKGFAKVELQPGETKAVTIEEQEKYVAAYFDEERDQWCVEKGDYEVIVSDSSAAKDGVALRGKFTVGETYWWSGV

SEQ ID NO: 158 - protein, 722 aa, Hypocrea jecorina
GPWAHAYRRAEKLVRQMTLEEKANITRGFTGDNVCAGNTGSVPRLGWPGMCVHDAGNGVRATDLVNSYPSGIHVGASWDRNLTYERGLHMGGEFKAKGVNVPLGPNAGPLGRTPLGGRNWEGFSIDPYLSGQLNAETITGMQDAGVIANIKHFIANEQETLRRPYFGVEAVSANIDDRTLHEYYLWPFMDSVHAGVGSVMCSYNRINNTYGCMNDKLMNGILKAELGFQGFVMLDWNAQHDLQSANAGLDMVMPLGGSWGKNLTDAVANGTVSESRITDMATRIIAAWYLVGQDGNNFPVPGIGLKQLTKPHEQVDARDPASKPVLLEGAIAGHVLVKNENNALPFNKKLTMISVFGYDATIPRTKNTDILFQLGYTSSPEMAQAVLGNEAHFDQAAKGGTIMTGGRAGANAPSYIDDPLAAIQRRARKDDTWVNWDLDSFNPEVNAASDACLVFINAIATEGWDRDGLHDDFSDGLVLNVAANCSNTIVVVHAAGTRLVDQWIEHPNVTAAVIAHLPGQDSGRALVKLLYGEANFSGKLPYTIAKNESDYSVYTPCQRRSPEDTDPQCDFTEGVYLDYRAFDANNMTPRFEFGYGLSYTSFNYSALSIKKAKGLRQSRCTDDLWQAAAQVTASITNSGGMSGSEVAQLYLAIPNSPPKQLRGFNKLLLRPHESGTVHFGLTKRDLSVWDVVSQSWVIQEGEYKVFVGASSRDIRLSGKLHI

SEQ ID NO: 159 - protein, 700 aa, Hypocrea jecorina
MILGCESTGVISAVKHFVANDQEHERRAVDCLITQRALREVYLRPFQIVARDARPGALMTSYNKVNGKHVADSAEFLQGILRTEWNWDPLIVSDWYGTYTTIDAIKAGLDLEMPGVSRYRGKYIESALQARLLKQSTIDERARRVLRFAQKASHLKVSEVEQGRDFPEDRVLNRQICGSSIVLLKNENSILPLPKSVKKVALVGSHVRLPAISGGGSASLVPYYAISLYDAVSEVLAGATITHEVGAYAHQMLPVIDAMISNAVIHFYNDPIDVKDRKLLGSENVSSTSFQLMDYNNIPTLNKAMFWGTLVGEFIPTATGIWEFGLSVFGTADLYIDNELVIENTTHQTRGTAFFGKGTTEKVATRRMVAGSTYKLRLEFGSANTTKMETTGVVNFGGGAVHLGACLKVDPQEMIARAVKAAADADYTIICTGLSGEWESEGFDRPHMDLPPGVDTMISQVLDAAPNAVVVNQSGTPVTMSWAHKAKAIVQAWYGGNETGHGISDVLFGNVNPSGKLSLSWPVDVKHNPAYLNYASVGGRVLYGEDVYVGYKFYDKTEREVLFPFGHGLSYATFKLPDSTVRTVPETFHPDQPTVAIVKIKNTSSVPGAQVLQLYISAPNSPTHRPVKELHGFEKVYLEAGEEKEVQIPIDQYATSFWDEIESMWKSERGIYDVLVGFSSQEISGKGKLIVPETRFWMGL

SEQ ID NO: 160 - protein, 836 aa, Hypocrea jecorina
WMDPSAPGWEQAYAQAKEFVSGLTLLEKVNLTTGVGWMGEKCVGNVGTVPRLGMRSLCMQDGPLGLRFNTYNSAFSVGLTAAASWSRHLWVDRGTALGSEAKGKGVDVLLGPVAGPLGRNPNGGRNVEGFGSDPYLAGLALADTVTGIQNAGTIACAKHFLLNEQEHFRQVGEANGYGYPITEALSSNVDDKTIHEVYGWPFQDAVKAGVGSFMCSYNQVNNSYACQNSKLINGLLKEEYGFQGFVMSDWQAQHTGVASAVAGLDMTMPGDTAFNTGASYFGSNLTLAVLNGTVPEWRIDDMVMRIMAPFFKVGKTVDSLIDTNFDSWTNGEYGYVQAAVNENWEKVNYGVDVRANHANHIREVGAKGTVIFKNNGILPLKKPKFLTVIGEDAGGNPAGPNGCGDRGCDDGTLAMEWGSGTTNFPYLVTPDAALQSQALQDGTRYESILSNYAISQTQALVSQPDAIAIVFANSDSGEGYINVDGNEGDRKNLTLWKNGDDLIKTVAAVNPKTIVVIHSTGPVILKDYANHPNISAILWAGAPGQESGNSLVDILYGKQSPGRTPFTWGPSLESYGVSVMTTPNNGNGAPQDNFNEGAFIDYRYFDKVAPGKPRSSDKAPTYEFGFGLSWSTFKFSNLHIQKNNVGPMSPPNGKTIAAPSLGSFSKNLKDYGFPKNVRRIKEFIYPYLSTTTSGKEASGDAHYGQTAKEFLPAGALDGSPQPRSAASGEPGGNRQLYDILYTVTATITNTGSVMDDAVPQLYLSHGGPNEPPKVLRGFDRIERIAPGQSVTFKADLTRRDLSNWDTKKQQWVITDYPKTVYVGSSSRDLPLSARLP

SEQ ID NO: 161 - protein, 740 aa, Hypocrea jecorina
KNNLVCDSSAGYVERAQALISLFTLEELILNTQNSGPGVPRLGLPNYQVWNEALHGLDRANFATKGGQFEWATSFPMPILTTAALNRTLIHQIADIISTQARAFSNSGRYGLDVYAPNVNGFRSPLWGRGQETPGEDAFFLSSAYTYEYITGIQGGVDPEHLKVAATVKHFAGYDLENWNNQSRLGFDAIITQQDLSEYYTPQFLAAARYAKSRSLMCAYNSVNGVPSCANSFFLQTLLRESWGFPEWGYVSSDCDAVYNVFNPHDYASNQSSAAASSLRAGTDIDCGQTYPWHLNESFVAGEVSRGEIERSVTRLYANLVRLGYFDKKNQYRSLGWKDVVKTDAWNISYEAAVEGIVLLKNDGTLPLSKKVRSIALIGPWANATTQMQGNYYGPAPYLISPLEAAKKAGYHVNFELGTEIAGNSTTGFAKAIAAAKKSDAIIYLGGIDNTIEQEGADRTDIAWPGNQLDLIKQLSEVGKPLVVLQMGGGQVDSSSLKSNKKVNSLVWGGYPGQSGGVALFDILSGKRAPAGRLVTTQYPAEYVHQFPQNDMNLRPDGKSNPGQTYIWYTGKPVYEFGSGLFYTTFKETLASHPKSLKFNTSSILSAPHPGYTYSEQIPVFTFEANIKNSGKTESPYTAMLFVRTSNAGPAPYPNKWLVGFDRLADIKPGHSSKLSIPIPVSALARVDSHGNRIVYPGKYELALNTDESVKLEFELVGEEVTIENWPLEEQQIKDATPDA

SEQ ID NO: 162 - protein, 840 aa, Kluyveromyces marxianus
VEQLLSELNQDEKISLLSAVDFWHTKKIERLGIPAVRVSDGPNGIRGTKFFDGVPSGCFPNGTGLASTFDRDLLETAGKLMAKESIAKNAAVILGPTTNMQRGPLGGRGFESFSEDPYLAGMATSSVVKGMQGEGIAATVKHFVCNDLEDQRFSSNSIVSERALREIYLEPFRLAVKHANPVCIMTAYNKVNGDHCSQSKKLLIDILRDEWKWDGMLMSDWFGTYTTAAAIKNGLDIEFPGPTRWRTRALVSHSLNSREQITTEDVDDRVRQVLKMIKFVVDNLEKTGIVENGPESTSNNTKETSDLLREIAADSIVLLKNKNNYLTSKERRQYHVIGPNAKAKTSSGGGSASMNSYYVVSPYEGIVNKLGKEVDYTVGAYSHKSIGGLAESSLIDAAKPADAENAGLIAKFYSNPVEERSEDEEPFHVTKVNRSNVHLFDFKHEKVDPKNPYFFVTLTGQYVPQEDGDYIFSLQVYGSGLFYLNDELIIDQKHNQERGSFCFGAGTKERTKKLTLKKGQVYNVRVEYGSGPTSGLVGEFGAGGFQAGVIKAIDDDEEIRNAAELAAKHDKAVLIIGLNGEWETEGYDRENMDLPKRTNELVRAVLKANPNTVIVNQSGTPVEFPWLEEANALVQAWYGGNELGNAIADVLYGDVVPNGKLSLSWPFKLQDNPAFLNFKTEFGRVVYGEDIFVGYRYYEKLQRKVAFPFGYGLSYTTFELDISDFKVTDDKIDISVDVKNTGDKFAGSEVVQVYFSALNSKVSRPVKELKGFEKVHLEPGEKKTVNIELELKDAISYFNEELGKWHVEAGEYLVSVGTSSDDILSVKEFKVEKDLYWKGL

SEQ ID NO: 163 - protein, 721 aa, Kuraishia capsulata
PEISGLGDWQFAYQRAREIVALMTNEEKTNLTFGSSGDTGCSGMISDVPDVDFPGLCLQDAGNGVRGTDMVNAYASGLHVGASWNRQLAYDRAVYMGAEFRHKGVNVLLGPVVGPIGRVATGGRNWEGFTNDPYLAGALVYETTKGIQENVIACTKHFIGNEQETNRNPSGTYNQSVSANIDDKTMHELYLWPFQDSVRAGLGSIMGSYNRVNNSYACKNSKVLNGLLKSELGFQGFVVSDWGGQHTGIASANAGLDMAMPSSTYWEEGLIEAVKNGTVDQSRLDDMATRIIAAWYKYARLDDPGFGMPVSLAEDHELVDARDPAAASTIFQGAVEGHVLVKNENALPLKKPKYISLFGYDGVSTDVNTVGGGFSFFSFDVKAIENKTLISGGGSGTNTPSYVDAPFNAFVAKAREDNTFLSWDFTSAEPVANPASDACIDFINAAASEGYDRPNLADKYSDKLVEAVASQCSNTIVVIHNAGIRLVDNWIEHENVTGVILAHLPGQDTGTSLIEVLYGNQSPSGRLPYTVAKKASDYGGLLWPTEPEGDLDLYFPQSNFTEGVYIDYKYFIQKNITPRYEFGYGLTYTTFDYSELEVDAITNQSYLPPDCTIEEGGAKSLWDIVATVKFTVTNTGDVAAAEVPQLYVGIPNGPPKVLRGFDKKLIHPGQSEEFVFELTRRDLSTWDVVAQNWGLQAGTYQFYVGRSVFDVPLTSALVFTN

SEQ ID NO: 164 - protein, 827 aa, Periconia sp.
PWMDPSAAGWAEAYTKAQAFVRQLTLLEKVNLTTGVGWEGEACVGNTGSIPRLGFPGFCTQDSPLGVRFADYVSAFTAGGTIAASWDRSEFYRRGYQMGVEHRGKGVDVQLGPVVGPIGRHPKGGRNWEGFSPDPVLSGIAVAETVKGIQDAGVIACTKHFILNEQEHFRQPGNVGDFGFVDAVSANLADKTLHELYLWPFADAVRAGTGSIMCSYNKANNSQVCQNSYLQNYILKGELGFQGFTMSDWDAQHSGVASTLAGLDMNMPGDTDFDSGFSFWGPNMTLSIINGTVPEWRLDDAATRIMAAYYLVGRDRHAVPVNFNSWSKDTYGYQHAYAKVGYGLINQHVDVRADHFKSIRTAAAKSTVLLKNNGVLPLKGTEKYTAVFGNDAGEAQYGPNGCADHGCDNGTLAMGWGSGTADYPYLVTPLEAIKRTVGDHGGVIASVTDNYAFSQIMALAKQATHAIVFVNADSGEGYITVDGNEGDRNNLTLWQNGEELVRNVSGYCNNTIVVIHSVGPVLVDSFNNSPNVSAILWAGLPGQESGNAITDVLYGRVNPGGKLPFTIGKSAEEYGPDIIYEPTAGHGSPQANFEEGVFIDYRSFDKKNITPVYEFGFGLSYTNFSYSNLVVTRVNAPAYVPTTGNTTAAPTLGNSSKDASDYQWPANLTYVNKYIYPYLNSTDLKEASNDPEYGIEHEYPEGATDGSPQPRIAAGGGPGGNPQLWDVLYKVTATVTNNGAVAGDEVAQLYVSLGGPEDPPVVLRNFDRLTIAPGQSVEFTADITRRDVSNWDTVSQNWVISNSTKTVYVGASSRKLPLKATLPSSSY

SEQ ID NO: 165 - protein, 827 aa, Phaeosphaeria avenaria
PWIEGLGDWEAAYQKAQAFVSQLTLLEKVNLTTGTGWQSDHCVGNTGGVPRLNFTGICNQDAPLGVRFADYVSAFPSGGTIAAAWDRGEWYLRGYQMGSEHRSKGVDVQLGPVVGPLGRNPKGGRNWEGFSPDPYLSGIASAESVRGIQDAGVIACTKHYIMNEQEHFRQPGNFEDQGFVDALSSNLDDKTLHELYLWPFADAVRAGTGSIMCSYNKVNNSQACQNSYLQNYILKGELGFQGFIMSDWDAQHSGVASTFAGLDMTMPGDTDFNSGKTFWGTNFTTSILNGTVPQWRLDDAVTRIMAAFYYVGRDKARIPVNFDSWSRDTYGFDHYYGKAGYSQINSHVDVRADHFRSIRRTAAMSTVLLKNEGALPLTGSEKWTAVFGDDAGEGQLGPNGFPDHGGNNGTLAMGWGSGTSDYPYLVTPLESIKATVAQNGGIVTSVTDNWAYTQIQTLAKQASVAIVFVNADSGEGYITVDGNAGDRNNLTLWQDGDTLIKNVSSLCNNTIVVIHSVGPVLVNSFYDSENVTAILWAGLPGQESGNAIADILYGRHNPGGKLPFTIGSDAAEYGPDLIYEPTNNSSSPQDNFEEGVFIDYRAFDKQNVTPIYEFGFGLSYTKFSYSNLTVKKANAGAYTPATGQSKAAPTLGNFSTDASQYQWPSDFTYIDTFIYPYLNSTDLKTASQDPEYGLNYTWPAGATDGTPQARIPAGGAPGGNPQLWDVLFSVEATITNNGTVPGDEVVQLYVSLGNPDDPKIVLRGFDRLSIQPGKTATFHADITRRDVSNWDVASQNWVITSAPKTVYVGASSRKLPLTATLDTSDFQ

SEQ ID NO: 166 - protein, 724 aa, Phanerochaete chrysosporium
TVANVSPEWAAAYVKAQAAVAKLSVTDMVNLATGVQWEKGPCVGNTPAISSIPGFTGLCLQDSPVGVRYADGTSVFPPEINVAATWNRTLMRQRGAAMGAEFKGKGVHVALGPMMNLMRVPAAGRNWEGGGGDPFLSGELAFETITGIQSSGAQACAKHFINNEQEHFRDSSSSNVDDRTEHELYGHPFLRSVQANVASVMCSYNQINGTFSCENEKTLSGLLKGEYGFQGYVMSDWWATHSGAPAVNAGLDMTMPGDETTNSGTTYFGQNLVNAVNSGQVSQARIKDMATRILAAWYLLGQDQNFPAVNFNSWNSGQGQHVNVSGNHASLIRTIGAASQILLKNVNGALPLKKPKTIGIIGNGAGSNPSGPNAFSDRAGDVGVLALGWGSGTANFPYLVAPVDAITARASQDGTTVSSSLSDTDLTGAANTATGKDVAMVFITADSGEGYLTVEGNAGDRNDLQAWHGGDALVQQVASHNKNTIVVINSVGPINMEAWVNHPNVTAIVWSGLPGQEAGNAVTDVLFGAVNPGGKLPFTIGKSISDYSAQIITTGSGIVPIPYNEGLFIDYRHFDQAGIAPRFEFGFGLSYTTFDYSNLVITGSTAGGTRQPPGPGSSLDPWLHDSVVTVSFTLTNNGTVDGTEVPQLYLSPPTSAKSAPQNLKGFDSGFLPAGASTTVSFELSRYSFSVWDVVSQSWQIPAGVTGISVGASSRDLRLKGSITN

SEQ ID NO: 167 - protein, 724 aa, Phanerochaete chrysosporium
TVANVSPEWAAAYVKAQAAVAKLSVTDMVNLATGVQWQKGPCVGNTPAISSIPGFTGLCLQDSPVGVRYADGTSVFPPEINVAATWNRTLMRQRGAAMGAEFKGKGVHVALGPMMNLMRVPAAGRNWEGGGGDPFLSGEVAFETITGIQSSGAQACAKHFINNEQEHFRDSSSSNVDDRTEHELYGHPFLRSVQANVASVMCSYNQINGTFSCENEKTLSGLLKGEYGFQGYVMSDWWATHSGAPAVNAGLDMTMPGDETLSSGTTYFGQNLVNAVNSGQVSQARVKDMATRILAAWYLLGQDQNFPAVNFNSWNSGQGQHVNVSGNHASLIRTIGAASQILLKNVNSALPLKKPKTIGIIGNGAGSNPNGPNAFSDRAGDVGVLALGWGSGTANFPYLVAPVDAITARASQDGTTVSSSLSDTDLTGAANTATGKDVAMVFITADSGEGYLTVEGNAGDRNDLQAWHGGDALVQQVASHNKNTIVVINSVGPINMEAWVNHPNVTAIVWSGLPGQEAGNAVTDVLFGAVNPGGKLPFTIGKSISDYSAQIITTGSGIVPIPYNEGLFIDYRHFDQAGIAPRFEFGFGLSYTTFDYSNLVITGSTAGGTRQPPGPGSSLDPWLHDSVVTVSFTLTNNGTVDGTEVPQLYLSPPASAKSAPQNLKGFDSVFLPAGASTTVSFELSRYSFSVWDVVSQSWQIPAGVTGISVGASSRDLRLKGSITN

SEQ ID NO: 168 - protein, 775 aa, Pichia anomala
GKWQAAFYRARELVDQMSIAEKVNLTTGVGSASGPCSGNTGSVPRLNISSICVQDGPLSVRAADLTDVFPCGMAASSSFNKQLIYDRAVAIGSEFKGKGADAILGPVYGPMGVKAAGGRGWEGHGPDPYLEGVIAYLQTIGIQSQGVVSTAKHLIGNEQEHFRFAKKDKHAGKIDPGMFNTSSSLSSEIDDRAMHEIYLWPFAEAVRGGVSSIMCSYNKLNGSHACQNSYLLNYLLKEELGFQGFVMTDWGALYSGIDAANAGLDMDMPCEAQYFGGNLTTAVLNGTLPQDRLDDMATRILSALIYSGVHNPDGPNYNAQTFLTEGHEYFKQQEGDIVVLNKHVDVRSDINRAVALRSAVEGVVLLKNEHETLPLGREKVKRISILGQAAGDDSKGTSCSLRGCGSGAIGTGYGSGAGTFSYFVTPADGIGARAQQEKISYEFIGDSWNQAAAMDSALYADAAIEVANSVAGEEIGDVDGNYGDLNNLTLWHNAVPLIKNISSINNNTIVIVTSGQQIDLEPFIDNENVTAVIYSSYLGQDFGTVLAKVLFGDENPSGKLPFTIAKDVNDYIPVIEKVDVPDPVDKFTESIYVDYRYFDKYNKPVRYEFGYGLSYSNFSLSDIEIQTLQPFSENAEPAANYSETYQYKQSNMDPSEYTVPEGFKELANYTYPYIHDASSIKANSSYDYPEGYSTEQLDGPKSLAAGGLGGNHTCGMLVTLSLLKSQIKVLMLVGLHLNCMLDIQIMMNSQHLQCNYVDLKRCFWIKIILKLFLLN

SEQ ID NO: 169 - protein, 853 aa, Piromyces sp.
VSQVFATSWSEADEKAKSFMSDLSESEKIDIVTGYMNMQGTCVGNIKPLDRKNFKGLCLQDGPAGVRFNGGTSTTWQAGINNAATFNKDLLYKIGKDQGAEFYAKGINIALAPSMNILRAPASGRVWENFGEDPYLSGVCGAQITKGYQDSGVIVAAKHYVANDIEHNREASSSNMDDQTLMEIHVEPFYRTIKDGDAGSVMASYNAVNNIYVVQNKKVLTEILKEGIGFQGFVMSDWWAIHDLEGSFNAGMDMNMPGGKAWGPDYVNNSFWGSNISNAIRSGQVSSSRLDDAVRRIIRTLYRFDQMSGYPNVNLKAPSMHADTNRQAAIESSVLLKNADDILPLTKKYRKIAIIGKDADKAQSCTDTACSGGNIIQGWGSGTTDFTGISDPITAIKNRASKEGISIVSSISDSANEGANVAKDADVAVVFVRATSGEEYIVVDNNKGDRNNLDLWHGGNDLVKSVAAVNKNTVVVIHAPATVNLPFLNNVKAIIHAGMPGAESGNAIASILFGDSNPSGHLPFTWAAREDYCCDVSYPAELPHGGNSKTAYDYKEGLFVGYRWFDKKNKTPIFPFGHGLSYTTFDYSNLSVSLKKSGTQVTGLEATVTVANTGSYEGATVPMLFLGFPAVSELGDYPVRNLKAFEKVNLKAGEKKTVTLTVDQHGLSYYNTSKKSFVVPTGGEFTVYVGKSAGDLPLKKAIKNTQGTNESSSSVGDENNNNPNNNADCSVNGYKCCSNSNAEVVYTDGDGNWGVENGQWCIIKEQQQQQTCFSIKLGYPCCKGNEVAYTDNDGQWGFENGQWCGIATATSGAGGCPYTSKNGYPVCQTTTKVEYVDSDKWGVENGNWCIMCN

SEQ ID NO: 170 - protein, 833 aa, Saccharomycopsis fibuligera
QGGRLQGVWQDAYTKAKALVSQMTIVEKVNLTTGTGWQLGPCVGNTGSVPRFGIPNLCLQDGPLGVRLTDFSTGYPSGMATGATFNKDLFLQRGQALGHEFNSKGVHIALGPAVGPLGVKARGGRNFEAFGSDPYLQGIAAAATIKGLQENNVMACVKHFIGNEQDIYRQPSNSKVDPEYDPATKESISANIPDRAMHELYLWPFADSIRAGVGSVMCSYNRVNNTYSCENSYMINHLLKEELGFQGFVVSDWAAQMSGAYSAISGLDMSMPGELLGGWNTGKSYWGQNLTKAVYNETVPIERLDDMATRILAALYATNSFPTKDRLPNFSSFTTKEYGNEFFVDKTSPVVKVNHFVDPSNDFTEDTALKVAEESIVLLKNEKNTLPISPNKVRKLLLSGIAAGPDPKGYECSDQSCVDGALFEGWGSGSVGYPKYQVTPFEEISANARKNKMQFDYIRESFDLTQVSTVASDAHMSIVVVSAVSGEGYLIIDGNRGDKNNVTLWHNSDNLIKAVAENCANTVVVITSTGQVDVESFADHPNVTAIVWAGPLGDRSGTAIANILFGNANPSGHLPFTVAKSNDDYIPIVTYNPPNGEPEDNTLAEHDLLVDYRYFEEKNIEPRYAFGYGLSYNEYKVSNAKVSAAKKVDEELPQPKLYLAEYSYNKTEEINNPEDAFFPSNARRIQEFLYPYLDSNVTLKDGNYEYPDGYSTEQRTTPIQPGGGLGGNDALWEVAYKVEVDVQNLGNSTDKFVPQLYLKHPEDGKFETPVQLRGFEKVELSPGEKKTVEFELLRRDLSVWDTTRQSWIVESGTYEALIGVAVNDIKTSVLFTI

SEQ ID NO: 171 - protein, 831 aa, Saccharomycopsis fibuligera
QGGRLQDVWQEAYARAKAIVGQMTIVEKVNLTTGTGWQLDPCVGNTGSVPRFGIPNLCLQDGPLGVRFADFVTGYPSGLATGATFNKDLFLQRGQALGHEFNSKGVHIALGPAVGPLGVKARGGRNFEAFGSDPYLQGTAAAATIKGLQENNVMACVKHFIGNEQEKYRQPDDINPATNQTTKEAISANIPDRAMHALYLWPFADSVRAGVGSVMCSYNRVNNTYACENSYMMNHLLKEELGFQGFVVSDWGAQLSGVYSAISGLDMSMPGEVYGGWNTGTSFWGQNLTKAIYNETVPIERLDDMATRILAALYATNSFPTEDHLPNFSSWTTKEYGNKYYADNTTEIVKVNYNVDPSNDFTEDTALKVAEESIVLLKNENNTLPISPEKAKRLLLSGIAAGPDPIGYQCEDQSCTNGALFQGWGSGSVGSPKYQVTPFEEISYLARKNKMQFDYIRESYDLAQVTKVASDAHLSIVVVSAASGEGYITVDGNQGDRKNLTLWNNGDKLIETVAENCANTVVVVTSTGQINFEGFADHPNVTAIVWAGPLGDRSGTAIANILFGKANPSGHLPFTIAKTDDDYIPIETYSPSSGEPEDNHLVENDLLVDYRYFEEKNIEPRYAFGYGLSYNEYEVSNAKVSAAKKVDEELPEPATYLSEFSYQNAKDSKNPSDAFAPADLNRVNEYLYPYLDSNVTLKDGNYEYPDGYSTEQRTTPNQPGGGLGGNDALWEVAYNSTDKFVPQGNSTDKFVPQLYLKHPEDGKFETPIQLRGFEKVELSPGEKKTVDLRLLRRDLSVWDTTRQSWIVESGTYEALIGVAVNDIKTSVLFTI

SEQ ID NO: 172 - protein, 832 aa, Schizosaccharomyces pombe
MMEHDVEDLINQLDISEKAMLLSGTDLWHTAAIPRLNIPSIRLSDGPNGIRGTSFFNSSPSACFPCGTALGATFDKKLLFEVGEYLAEEAKAKGVSVVLGPTVNIHRGPLNGRGFESFSEDSTLSGLAASYVILGLQSKNVQACIKHFVCNDMEDERNSVSIDVSQRALREVYLMPFQLACKYSNFKSLMTSYNKVNGEHVSQSRILLDNILRKEWEWKGTIISDWFGTYSLKKAIDAGLDLEMPGKPRFRNVNTIQHLVGSKELSESILDERAKNVLKLVKHSWQNTEAENHCELNNDSSCLREALKKFASQSIVLLKNKKKLLPLSRKGTFAVIGPNAKVCNYSGGGSANLKPYYTVSMYDGIAAKIDGVPEYALGCHNYLNLPNIANLLVNPRTGKHGYVAKFYLEPATSENRTLIDDYDLEDGVVRFYDYCNDKMKDGYFYIDIEGYLIPDEDAVYEFGISVFGTALLFIDDVLLIDNKTKQTPTNHTFEFGTIEERNSIYLKKGRKYNVRVEYGSAATYTLSTNLSPSTGGRYSIGCVKVIDPETEIDYAVRVAKSVDCVILCVGLTAEWETEGEDRKTMTLPSLSDKLVYSILQSNPNTVVVTQSGTPIEMPWISEAHTLLHIWYNGNELGNALANIIFGEQNPCGKLPITFPKKLKDNPAYLSFRSSRGHCVYGEDVFVGYKYYEAVEREVLFPFGYGLSYTTFELSNLYLKNCGERLRIDLEISNTGPMSGAEIIQVYISQIVRSVNRPVKELKEFSKVVLCPKETKLIRIELDIKYATSFYDELNEKWCSEEGEYNVLVGTSSKDIALTGKFTLPKTIHWTGL

SEQ ID NO: 173 - protein, 761 aa, Septoria lycopersici
WKAAFEKAADAVSRLNLTQKVALTTGTTAGLSCNGNIAPIPEINFSGLCLADGPVSVRIADLATVFPAGLTAAATWDRQLIYERARALGSEFRGKGSQVHLGPASGALGRHPLGGRNWESFSPDPYLSGVAMDFSIRGIQEMGVQANRKHFIGNEQETQRSNTFTDDGTEIQAISSNIDDRTMHELYLWPFANAVRSGVASVMCSYNRLNQTYACENSKLMNGILKGELGFQGYVVSDWYATHSGVESVNAGLDMTMPGPLDSPSTALRPPPSYLGGNLTEAVLNGTIPEARVDDMARRILMPYFFLGQDTDFPTVDPSTGFVFARTYNYPDEYLTLGGLDPYNPPPARDVRGNHSDIVRKVAAAGTVLLKNVNNVLPLKEPKSVGIFGNGAADVTEGLTFTGDDSGPWGADIGALSVGGGSGAGRHTHLVSPLAAIRKRTESVGGRVQYLLSNSRIVNDDFTSIYPTPEVCLVFLKTWAREGTDRLSYENDWNSTAVVNNVARRCPNTIVVTHSGGINTMPWADNANVTAILAAHYPGQENGNSIMDILYGDVNPSGRLPYTIPKLATDYDFPVVNITNEAQDPYVWQADFTEGLLIDYRHFDARNITPLYEFGYGLSYTTFEIEGVANLVAKSAKLSAFPASTDISHPGGNPDLWEEVVSVTAAVKNTGSVSGSQVVQLYISLPADGIPENSPMQVLRGFEKVDLQPGQSKSVEFSIMRRDLSFWNTTAQDWEIPNGQIEFRVGFSSRDIKSIVSRSFL

SEQ ID NO: 174 - protein, 826 aa, Talaromyces emersonii
PWANGQGDWAEAYQKAVQFVSQLTLAEKVNLTTGTGWEQDRCVGQVGSIPRLGFPGLCMQDSPLGVRDTDYNSAFPAGVNVAATWDRNLAYRRGVAMGEEHRGKGVDVQLGPVAGPLGRSPDAGRNWEGFAPDPVLTGNMMASTIQGIQDAGVIACAKHFILYEQEHFRQGAQDGYDISDSISANADDKTMHELYLWPFADAVRAGVGSVMCSYNQVNNSYACSNSYTMNKLLKSELGFQGFVMTDWGGHHSGVGSALAGLDMSMPGDIAFDSGTSFWGTNLTVAVLNGSIPEWRVDDMAVRIMSAYYKVGRDRYSVPINFDSWTLDTYGPEHYAVGQGQTKINEHVDVRGNHAEIIHEIGAASAVLLKNKGGLPLTGTERFVGVFGKDAGSNPWGVNGCSDRGCDNGTLAMGWGSGTANFPYLVTPEQAIQREVLSRNGTFTGITDNGALAEMAAAASQADTCLVFANADSGEGYITVDGNEGDRKNLTLWQGADQVIHNVSANCNNTVVVLHTVGPVLIDDWYDHPNVTAILWAGLPGQESGNSLVDVLYGRVNPGKTPFTWGRARDDYGAPLIVKPNNGKGAPQQDFTEGIFIDYRRFDKYNITPIYEFGFGLSYTTFEFSQLNVQPINAPPYTPASGFTKAAQSFGQPSNASDNLYPSDIERVPLYIYPWLNSTDLKASANDPDYGLPTEKYVPPNATNGDPQPIDPAGGAPGGNPSLYEPVARVTTIITNTGKVTGDEVPQLYVSLGGPDDAPKVLRGFDRITLAPGQQYLWTTTLTRRDISNWDPVTQNWVVTNYTKTIYVGNSSRNLPLQAPLKPYPGI

SEQ ID NO: 175 - protein, 817 aa, Thermoascus aurantiacus
WVSDWAPAYAKAYEVVSNMTLAEKVNMTTGTGIFMGPCVGQTGSALRFGIPNLCLMDSPLGIRNTDHNTAFPAGITVGATFDKELMYARGVALGEEARGKGVNVLMGPMVGPIGRKPRGGRNWEGFGADPTLQAIGGAQTIKGMQSTGVIATLKHFIGNEQEMYRMTSVIQRGYSSNIDDRTLHELYLWPFAEGVRAGVGSVMMAYNDVNGSACSQNSKLINGILKDELGFQGFVMTDWLTQIGGVSSALAGLDMAMPGDGPIPLFGDSYWGSELSRAVLNGTVPVDRLNDMVTRIVATWYKFGQDKDFPLPNFSSNTDAATGLLYPGAVFSPIGVVNQFVDVQGDHKVVARAIARDAITLLKNEDNALPLKRNDSLKIFGTDAGTNPDGINSCADKGCDKGVLTMGWGSGTSKLPYLNTPQEAIANASSNAEFFVTDSFPSNVNANPEDIAIVFINADSGENYITVEGNYGDRSAAGLYAWHNGDDLVKAAAAKFSKVVVVVHTVGPIILENWIDLPSVKSVVFAHLPGQEAGDSLVDVLFGDYSPSGHLPYTIPRSEDQYPSSVSLINQPFGQIQDTFTEGLYIDYRHFLHANLTPRYPFGHGLSYTTFNITEATISVVIPLQSEYPPTRPPKGPTPTYNNVIPPASEVAWPENFDRIWRYIYPYLDNPAAATSTAPYPYPTGYTTVPQPAPRAGGAEGGNPALWDVAFSVRVKVSNTGSRPGRAVAQLYVELPSSLGLDTPRLQLRQFEKTKTLAPGESEVLTMELTRKDLSVWDVVVQDWKAPLNGQGVKVWIGESVADLRVVCEVGRECRNI

SEQ ID NO: 176 - protein, 829 aa, Thermoascus aurantiacus
PWMDGNGEWAEAYRRAVDFVSQLTLAEKVNLTTGVGWMQEKCVGETGSIPRLGFRGLCLQDSPLGVRFADYVSAFPAGVNVAATWDKNLAYLRGKAMGEEHRGKGVDVQLGPVAGPLGRHPDGGRNWEGFSPDPVLTGVLMAETIKGIQDAGVIACAKHFIGNEMEHFRQASEAVGYGFDITESVSSNIDDKTLHELYLWPFADAVRAGVGSFMCSYNQVNNSYSCSNSYLLNKLLKSELDFQGFVMSDWGAHHSGVGAALAGLDMSMPGDTAFGTGKSFWGTNLTIAVLNGTVPEWRVDDMAVRIMAAFYKVGRDRYQVPVNFDSWTKDEYGYEHALVGQNYVKVNDKVDVRADHADIIRQIGSASVVLLKNDGGLPLTGYEKFTGVFGEDAGSNRWGADGCSDRGCDNGTLAMGWGSGTADFPYLVTPEQAIQNEILSKGKGLVSAVTDNGALDQMEQVASQASVSIVFVNADSGEGYINVDGNEGDRKNLTLWKGGEEVIKTVAANCNNTIVVMHTVGPVLIDEWYDNPNVTAIVWAGLPGQESGNSLVDVLYGRVSPGGKTPFTWGKTRESYGAPLLTKPNNGKGAPQDDFTEGVFIDYRRFDKYNETPIYEFGFGLSYTTFEYSDIYVQPLNARPYTPASGSTKAAPTFGNISTDYADYLYPEDIHKVPLYIYPWLNTTDPKKSSGDPDYGMKAEDYIPSGATDGSPQPILPAGGAPGGNPGLYDEMYRVSAIITNTGNVVGDEVPQLYVSLGGPDDPKVVLRNFDRITLHPGQQTMWTTTLTRRDISNWDPASQNWVVTKYPKTVYIGSSSRKLHLQAPLPPY

SEQ ID NO: 177 - protein, 829 aa, Thermoascus aurantiacus
PWMNGNGEWAEAYRRAVDFVSQLTLAEKVNLTTGVGWMQEKCVGETGSIPRLGFRGLCLQDSPLGVRFADYISAFPAGVNVAATWDKNLAYLRGKAMGEEHRGKGVDVQLGPVAGPLGRHPDGGRNWEGFSPDPVLTGVLMAETIKGIQDAGVIACAKHFIGNEMEHFRQASEAVGYGFDITESVSSNIDDKTLHELYLWPFADAVRAGVGSFMCSYNQVNNSYSCSNSYLLNKLLKSELDFQGFVMSDWGAHHSGVGAALAGLDMSMPGDTAFGTGKSFWGTNLTIAVLNGTVPEWRVDDMAVRIMAAFYKVGRDRYQVPVNFDSWTKDEHGYEHALVGQDYVKVNDKVDVRADHADIIRQIGSASVVLLKNDGGLPLTGYEKFTGVFGEDAGSNRWGADGCSDRGCDNGTLAMGWGSGTADFPYLVTPEQAIQNEILSKGKGLVSAVTDNGALDQMEQVASQASVSIVFVNADSGEGYINVDGNEGDRKNLTLWKGGEEVIKTVAANCNNTIVVMHTVGPVLIDEWYDNPNVTAIVWAGLPGQESGNSLVDVLYGRVSPGGKTPFTWGKTRESYGAPLLTKPNNGKGAPQDDFTEGVFIDYRRFDKYNETPIYEFGFGLSYTTFEYSNIYVQPLNARPYTPASGSTKAAPTFGNISTDYADYLYPEDIHKVPLYIYPWLNTTDPKKSSGDPDYGMKAEDYIPSGATDGSPQPILPAGGAPGGNPGLYDEMYRVSAIITNTGNVVGDEVPQLYVSLGGPDDPKVVLRNFDRITLHPGQQTMWTTTLTRRDISNWDPASQNWVVTKYPKTVYIGSSSRKLHLQAPLPPY

SEQ ID NO: 178 - protein, 821 aa, Thermoascus aurantiacus
PPGGWVSDWAPAYAKAYEVVSNMTLAEKVNMTTGTGIFMGPCVGQTGSALRFGIPNLCLMDSPLGIRNTDHNTAFPAGITVGATFDKELMYARGVALGEEARGKGVNVLMGPMVGPIGRKPRGGRNWEGFGADPTLQAIGGAQTIKGMQSTGVIATLKHFIGNEQEMYRMTSVIQRGYSSNIDDRTLHELYLWPFAEGVRAGVGSVMMAYNDVNGSACSQNSKLINGILKDELGFQGFVMTDWLTQIGGVSSALAGLDMAMPGDGPIPLFGDSYWGSELSRAVLNGTVPVDRLNDMVTRIVATWYKFGQDKDFPLPNFSSNTDAATGLLYPGAVFSPIGVVNQFVDVQGDHKVVARAIARDAITLLKNEDNALPLKRNDSLKIFGTDAGTNPDGINSCADKGCDKGVLTMGWGSGTSKLPYLNTPQEAIANASSNAEFFVTDSFPSNVNANPEDIAIVFINADSGENYITVEGNYGDRSAAGLYAWHNGDDLVKAAAAKFSKVVVVVHTVGPIILENWIDLPSVKSVVFAHLPGQEAGDSLVDVLFGDYSPSGHLPYTIPRSEDQYPSSVSLINQPFGQIQDTFIEGLYIDYRHFLHANLTPRYPFGHGLSYTTFNITEATISVVIPLQSEYPPTRPPKGPTPTYNNVIPPASEVAWPENFDRIWRYIYPYLDNPAAATSTAPYPYPTGYTTVPQPAPRAGGAEGGNPALWDVAFSVRVKVSNTGSRPGRAVAQLYVELPSSLGLDTPRLQLRQFEKTKTLAPGESEVLTMELTRKDLSVWDVVVQDWKAPLNGQGVKVWIGESVADLRVMCEVGRECRNI

SEQ ID NO: 179 - protein, 716 aa, Trichoderma viride
VVLPAGTPWGTAYDKAKAALAKLNLQDKVGIVSGVGWNGGPCVGNTSPASKFSYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHATVQSANSGLDVSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWTGLPSQESGNALVDVLWGDVSPSGKLVYTIAKSPNDYNTRIVSGGSDSFSEGLFIDYKHFDDANITPRYEFGYGLCKFANTKFNYSRLSVLSTAKSGPATGAVVPGGPSDLLQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 180 - protein, 630 aa, Tropaeolum majus
EYMRYKDPKKPLNVRIKDLMSRMTLAEKIGQMTQIERKEATPDVISKYFIGSVLSGGGSVPAPKASPEAWVDLVNGMQKAALSTRLGIPMIYGIDAVHGHNNVYNATIFPHNVGLGVTRDPALIKRIGEATALECRATGIPYAFAPCIAVCRDPRWGRCYESYSEDHTIVQAMTEIIPGLQGDVPPDVKKGVPFVGGKTKVAACAKHFVGDGGTTKGIDENNTVIDSRGLFSIHMPAYHDSIKKGVATVMVSYSSWNGLRMHANRDLVTGYLKNKLKFRGFVISDWEGIDRITDPPGRNYSYSVEAGVGAGIDMIMVPEDFTKFLNELTSQVKKNIIPMSRIDDAVKRILRVKFVMGLFESPLADYSLANQLGSQEHRDLAREAVRKSLVLLKNGESADKPFVPLPKNAKKILVAGSHADNLGRQCGGWTIEWQGVNGNDLTTGTTILNAIKKTVDPTTQVIYNENPDSNYVKTNSFDYAIVVVGEPPYAEMQGDSFNLTIPEPGPTTISSVCGAVKCVVVVISGRPVVLQPYVSYMDALVAAWLPGTEGQGVTDVLFGDYGFTGKLARTWFKTVDQLPMNVGDKHYDPLFPFGFGLTTKPSNRTEFIGLIFGDLEMFSRYYVEGCKDGV

SEQ ID NO: 181 - protein, 754 aa, Uromyces viciae-fabae
PVQSGLSPWSESIVRARAFVAQLTIEEKVNLTTGAGTQGRCVGETGTVPRLGFNQPICLQDGPVGIRYTDFNSVFPAAINVAATFDKQLMFKRAQAMAEEFRGKGANVVLAPMTNLMRTPQAGRAWEGYGSDPYLSGVATVQSVLGIQSTRASACVKHYIGNEQEHYRGGSGATASSSNIDDRTLRELYEWPFAEAIHAGVDYIMCSYNRVNQTYACENSKLINGIAKGEHKFQGVMVTDWAAAESGVRTALAGTDMNMPGFMAYGQPSEPNPSTANGSYWGLRMIEAVKNGTVPMERLDDMVTRVISTYYKQGQDKSDYPKLNFMSMGQGTPAEQAVSNHHVNVQKDHYLIIRQIATASTILLKNVNHTLPLKSPDKMRSVVVVGSDAGDNPQGPNSCVDRGCNRGILAIGWGSGTANFAHLTAPATSIQNYLLQSNPTITYRSIFDDYAYDEIAKAASTADVSIVHVSSDSGEGYLTVEGNQGDRSNTSLWNKGDELILKAAEACNNVVVVIHSVGPVDMEAWINHPNVTAVLLAGLPGQEAGSAEVDVLWGSTNPSGRLPYTIAKKPSDYPAELLYESNMTVPQINYSERLNIDYRHFDTYNIEPRFEFGFGLSYTTFAWNSLKFSSSFQLQKTSPVIVPPNLDLYQDVIEFEFQVTNSGPFDGSEVAQLYVDFPNQVNEPPKVLRGFERAYIPSKQSKTIEIKLRVKDLSFWDVITQSWQIPDGKFNFMIGSSSRKIIFTQEISLQHSHM

SEQ ID NO: 182 - protein, 862 aa, Volvariella volvacea
MPPSDFAKANIDEIVEQLTLDEAISLTAGVGFWHTHAIERLGVPAVKVSDGPNGIRGNHFFMGTPAKCLPSSTALGATWDPEVVEEVGLKLLAPEAKLRAASLVLAPTSNIQRNPLGGRSFESFSEDPYLSGIISASYVNGVQKGGIGATIKHFVGNDKEDDRQGYDSIISERALREIYLLPFMLTQKYAAPWAIMTAYNRVNGVHVAEDPFLLKQVLRNEWKYKGLIMSDWFGMYSVDHGIKAGLDLEMPGINKWRTLDLVNRTIQARKLTPRDIKDRARVVLELVKKCAQGAPEILDGDGEERTVELESDKLLMRRIASESIVLLKNDNVLPLKPEGGAIKKIAVVGGNAKAQVLSGGGSAALKASYFISPYDGIKAALEPHGVEVTFSEGARAYKTLPTLEWDLETETGERGWIGTWHTHESDDSMTALDQPFIAPRLVDETRIFISTSYPKGITKRWTMRLKGYLKPREKDTNFEFGLIAAGRAKLWVDGQLVIDNWTRQRRGEAFFGSGSQEETGVYLLKAGKKHEIYVEYCNVRAPADGDEDEAIMDSNPGVRLGGAEVANADDLLSEAVKLASEADAVIAVVGLNADWETEGNDRRTLALPGRTDELVEKVAKVNSKTVVVTQAGSAITLPWLDSVAAVVHAWYLGNATGDAIADVLFGKQNPSGKLSLTFPKRLEDVPSHGHFGSENGKVRYAEDLFVGYKHYHHRNIEPLFPFGFGLSYTTFSLSNLQLSAPVIDHATSSFSLTATLSITNTGPVTGSEVAQLYVSYPETSELTHAPLQLRAFKKVKDLQPGETREVKLELDKYAVSYWNDRYQTWAVENGEYEIKVGNSSVSKDLTLVQRFVVKDGFEWRGI

Embodiments of the Invention in which an Exclusive Property or Privilege is Claimed are Defined as Follows:

1. A modified *Trichoderma reesei* TrCel3A beta-glucosidase comprising one or more amino acid substitutions selected from the group consisting of V43I, V43C, V101A, V101G, F260I, F260V, F260Q, F260D, I543N, I543W, I543A, I543S, I543G and I543L, the modified TrCel3A beta-glucosidase comprising an amino acid sequence which is from about 90% to about 99.9% identical to SEQ ID NO: 1 or 116, wherein the modified *Trichoderma reesei* TrCel3A beta-glucosidase exhibits at least one of
   a. at least a 20% increase in $K_G$,
   b. at least a 20% decrease in $K_{G2}$, or
   c. at least a 10% increase in $k_{cat}$
relative to the $K_G$, $K_{G2}$, or $k_{cat}$ of a parental *Trichoderma reesei* TrCel3A from which the modified *Trichoderma reesei* TrCel3A is derived.

2. The modified *Trichoderma reesei* TrCel3A beta-glucosidase of claim 1, wherein the modified *Trichoderma reesei* TrCel3A beta-glucosidase exhibits at least one of
   a. at least a 30% increase in $K_G$,
   b. at least a 30% decrease in $K_{G2}$, or
   c. at least a 20% increase in $k_{cat}$
relative to the $K_G$, $K_{G2}$, or $k_{cat}$ of a parental *Trichoderma reesei* TrCel3A from which the modified *Trichoderma reesei* TrCel3A is derived.

3. The modified *Trichoderma reesei* TrCel3A beta-glucosidase of claim 1, comprising an amino acid sequence which from about 95% to about 99.9% identical to SEQ ID NO: 1 or 116.

4. The modified *Trichoderma reesei* TrCel3A beta-glucosidase of claim 1, further comprising one or more amino acid substitutions selected from the group consisting of V66X, S72X, F96X, T235X, N248X, N369X and A386X.

5. The modified *Trichoderma reesei* TrCel3A beta-glucosidase of claim 2, further comprising one or more amino acid substitutions selected from the group consisting of V66X, S72X, F96X, T235X, N248X, N369X and A386X.

6. The modified *Trichoderma reesei* TrCel3A beta-glucosidase of claim 1, which comprises at least one amino acid sequence selected from the group consisting of:
   SEQ ID NO: 2 (TrCel3A-V43I);
   SEQ ID NO: 3 (TrCel3A-V43C);
   SEQ ID NO: 4 (TrCel3A-V101A);
   SEQ ID NO: 5 (TrCel3A-V101G);
   SEQ ID NO: 6 (TrCel3A-F260I);
   SEQ ID NO: 7 (TrCel3A-F260V);
   SEQ ID NO: 8 (TrCel3A-F260Q);
   SEQ ID NO: 9 (TrCel3A-F260D);
   SEQ ID NO: 10 (TrCel3A-I543N);
   SEQ ID NO: 11 (TrCel3A-I543W);
   SEQ ID NO: 12 (TrCel3A-I543A);
   SEQ ID NO: 13 (TrCel3A-I543S);
   SEQ ID NO: 14 (TrCel3A-I543G);
   SEQ ID NO: 15 (TrCel3A-I543L);
   SEQ ID NO: 16 (TrCel3A-572N-V101M-F260I);
   SEQ ID NO: 17 (TrCel3A-V43I-572N-V101M);
   SEQ ID NO: 18 (TrCel3A-572N-V101M-I543N);
   SEQ ID NO: 19 (TrCel3A-572N-V101M-I543D);
   SEQ ID NO: 20 (TrCel3A-572N-V101M-I543L);
   SEQ ID NO: 21 (TrCel3A-V431-572N-V101M-F260I);
   SEQ ID NO: 22 (TrCel3A-V431-572N-V101M-F260I-1543N);
   SEQ ID NO: 23 (TrCel3A-V431-572E-V101M-I543N);
   SEQ ID NO: 69 (TrCel3A-572N-V101M-F260I-I543N); and
   SEQ ID NO: 70 (TrCel3A-572N-V101M-F260I-I543L).

7. A modified Family 3 beta-glycosidase comprising one or more of the amino acid substitutions selected from the group consisting of selected from the group consisting of V43I, V43C, V101A, V101G, F260I, F260V, F260Q, F260D, I543N, I543W, I543A, I543S, I543G and I543L, said position determined from alignment of a parental Family 3 beta-glycosidase with the TrCel3A amino acid sequence as defined in SEQ ID NO: 1, wherein the amino acid sequence of the modified Family 3 beta-glycosidase comprises a sequence which is from about 90% to about 99.9% identical to an amino acid sequence of a parental Family 3 beta-glycosidase from which the modified Family 3 beta-glycosidase is derived, the modified Family 3 beta-glycosidase exhibiting at least one of
   a. an increase in $K_P$,
   b. a decrease in $K_S$, or
   c. an increase in $k_{cat}$
relative to the $K_P$, $K_S$, or $k_{cat}$ of a parental Family 3 beta-glycosidase from which the modified Family 3 beta-glycosidase is derived.

8. The modified Family 3 beta-glycosidase of claim 7, wherein the amino acid sequence of the modified Family 3 beta-glycosidase is from about 95% to about 99.9% identical to an amino acid sequence of a parental Family 3 beta-glycosidase from which the modified Family 3 beta-glycosidase is derived.

9. The modified *Trichoderma reesei* TrCel3A beta-glucosidase of claim 1, which comprises at least one amino acid sequence selected from the group consisting of:
   SEQ ID NO: 117 (TrCel3A-V43I full);
   SEQ ID NO: 118 (TrCel3A-V43C full);
   SEQ ID NO: 119 (TrCel3A-V101A full);
   SEQ ID NO: 120 (TrCel3A-V101G full);
   SEQ ID NO: 121 (TrCel3A-F260I full);
   SEQ ID NO: 122 (TrCel3A-F260V full);
   SEQ ID NO: 123 (TrCel3A-F260Q full);
   SEQ ID NO: 124 (TrCel3A-F260D full);
   SEQ ID NO: 125 (TrCel3A-I543N full);
   SEQ ID NO: 126 (TrCel3A-I543W full);

SEQ ID NO: 127 (TrCel3A-I543A full);
SEQ ID NO: 128 (TrCel3A-I543S full);
SEQ ID NO: 129 (TrCel3A-I543G full);
SEQ ID NO: 130 (TrCel3A-I543L full);
SEQ ID NO: 131 (TrCel3A-S72N-V101M-F260I full);
SEQ ID NO: 132 (TrCel3A-V43I-S72N-V101M full);
SEQ ID NO: 133 (TrCel3A-S72N-V101M-I543N full);
SEQ ID NO: 134 (TrCel3A-S72N-V101M-I543D full);
SEQ ID NO: 135 (TrCel3A-S72N-V101M-I543L full);
SEQ ID NO: 136 (TrCel3A-V43I-S72N-V101M-F260I full);
SEQ ID NO: 137 (TrCel3A-V43I-S72N-V101M-F260I-I543N full);
SEQ ID NO: 138 (TrCel3A-V43I-S72E-V101M-I543N full);
SEQ ID NO: 139 (TrCel3A-S72N-V101M-F260I-I543N full); and
SEQ ID NO: 140 (TrCel3A-S72N-V101M-F260I-I543L full).

10. A process for producing the modified *Trichoderma reesei* TrCel3A beta-glucosidase according to claim 1, comprising the steps of:
(i) providing an isolated genetically modified microbe comprising a nucleic acid sequence encoding said modified *Trichoderma reesei* TrCel3A beta-glucosidase;
(ii) culturing the genetically modified microbe in submerged liquid fermentations under conditions that induce the expression of the modified *Trichoderma reesei* TrCel3A beta-glucosidase; and
(iii) recovering the modified *Trichoderma reesei* TrCel3A beta-glucosidase.

11. A process for enzymatic hydrolysis of a cellulose substrate comprising contacting said substrate with one or more cellulase enzymes and the modified *Trichoderma reesei* TrCel3A beta-glucosidase of claim 1.

12. The process of claim 11, wherein the cellulose substrate is a pretreated lignocellulosic feedstock and wherein the process produces fermentable sugars.

13. The process of claim 12, wherein the pretreated lignocellulose feedstock is selected from the group consisting of corn stover, wheat straw, barley straw, rice straw, oat straw, canola straw, sugarcane straw, soybean stover, corn fiber, sugar beet pulp, pulp mill fines and rejects, sugar cane bagasse, hardwood, softwood, sawdust, switch grass, miscanthus, cord grass, and reed canary grass.

14. The process according to claim 10, wherein said isolated genetically modified microbe is a species of yeast or filamentous fungus.

15. The process according to claim 14, wherein said isolated genetically modified microbe is *Saccharomyces cerevisiae* or *Trichoderma reesei*.

* * * * *